United States Patent 9,719,064 (GENOMICS OF ACTINOPLANES UTAHENSIS) - sequence listing, part 9

SEQ ID NO: 16053 - DNA, 9087635 bp, Actinoplanes utahensis (residues 5,452,582-7,270,108 of 9,087,635)
gatcacgtccggcttggcggcgttcaccaggaagccggcgtcgagcagccgcgccgcgatctccgcggcgttcggctggttcagcacgatgccgagcagcaggcccgcgccacgaacctgcttgacgaacgggtgccgcagcccctcgatgcctcgccgcagctgctcgccgacccgcttcacgtgatcgagcaggccctcgccggcgatcgtgcggaccacggcgagcccggccgcgcaggagaccgggttcccgccgaaggtggtgccgtgcgagcccggggtgagcaggtcggcggccgtgccgaaggccaggcaggcgcccagcggcagcccgccgccgagacccttggccagggtgaccaggtcgggctcgacaccctcgccctggtggtggaaccagtggccggtgcggccgatgccggtctgcacctcgtcgagggtgagcagcgcgccgttgcgggtgcagatctcccgggccgcggccaggtaaccgggcgggggcacgaccacgccgttctccccctggatcggttccaggatgaccatggcggtctcaccggtgacggcggccgccagggcggcgacgtcgccgtacgcgatgtgggtgacgtcgccgggcagcggccggaacgggtcctgtttcgccggctggccggtcagggcgagcgcacccatggtgcgcccgtggaacgcgccgtcggtcgccacgatgtgggtgcgcccggtcagccgggagatcttgaaggcggcctcgttggcctcggcgccggagttgcagaacagcacccggccggtccggccggccaacgccagcagcagctcggccagggccaccggaggctccgcgatgtacaggttggagacgtggccgacctgctggatctgctgcgtgacggcggccaccacggcggggtgggcgtggccgagcgcgttgaccgcgatcccgccgaggaagtcgacataccgtcggccgtcctcggcggtgagcaccgcgccctcacccttgaccagagcgatcgccggggtgccgtagttgttcatcatggactgctgccagcgttcgacgagcgtcgtcatgaggggaccaccatggtaccgaatccttcttccgtgaagatttcgagcagcgtcgagtgggcgacccggccgtcgacgacgtgtgccgacgggaccccgccgcgcaccgcgcgcaggcaggcctccatcttggggaccatcccggactccaggccgggcagcagcctggcgagcgcgtcggcgtcgatctcgctggtcaacgaggaagtgtccggccagttggtgtaaaggccgggcacgtcggtgagcaccacgagcttgcgggcgccgagtgcgacggccagcgcggaggcggcggtgtcggcgttcacgttgtgcgccagcccgtcggcgtccggggcgaccgtggcgatcaccgggatccggccggccgcgatgagatcgtcgaccgcggaggtgtccacccggtcgacgtcgccgaccaggccgatgtcgacctgctcgccgtcgatcgtggcgccccggcggaccgcggtgaacagccgggcgtcctcgccggacaggcccaccgcgtacggcccgtgctggttgatcaggccgaccagctcccggccgacctggccggtgagcaccatccggacgatctccatcgtctccggggtggtgacccgcaggccgccgcggaactccgactcgatgccgacccgctggagcatccggttgatctgcggcccgccgccgtggaccacgaccggcttgatccccacatgccgcaggaagaccatgtcggcggcgaaggcgcgctgcagctccgggtcgatcatggcgttgccgccgtacttgatcacgatcgtcgcgccgtggaagcgctccagccatgggagcgcctcgatcaggatgcccgccttctccagcggggtcatgagctgtatgccgaattctcgtggacgtaggcgtgcgagagatccgtggtccagatcgtcgcgttcatctcaccctcgtgcaggttgatcgtcacccggacgtcccggccggacaggtcgaccttcgaccggtcctcggcggcggcgccgttgcggcacacccagacgccgttgatcgccacgtcgatccggtcggcctcgaacgccgcgctggtggtgccgaccgcggccaggatccggccccagttggggtcgttgccgaagaacgcggtcttcaccaggttgttgccggccaccgtgcggcccacctgtacggcgtcggcctcgctggccgcgccggccacctcgatcgcgatgtgcttggtggcgccctcggcgtcggcgatcagctgctgggccaggtcgtggcagacctcggtgaccgcggcggtcagctcggcgagtgtcggctgccggtccgaggcgccactggccagcagcagcacggtgtcgttggtcgacatgcagccgtccgcgtcgatccggtcgaaggtgacccgggtggccgcgcgcagcgccgcatccagcgtctcgttgtccgccgacgcatccgtggtaatcaccacgagcatggtggcgagcgccggggccagcatgccggcgcccttggcgataccgccgaccgaccagccgtcgcgctgggccaccgcgttcttggcgaccgtgtcggtcgtcatgatcgcctcggcggcccggggcccgccgtccgtggcgagcgccttgaccgcggcgttcacccccggcagcagcctgtccatcggcagaagctcgccgatcaggccggtcgagcagaccgcgatgtcaccggggccgaccatcatccgcttggtggtacgcagcaccgtggcggtgtgctcggcggtggtgtgggtgtcccggaaaccctgcgatccggtgcacgcgttggcaccaccggagttcagcacgaccgcgcggatcactccgcccttgaccacctgctggctccacagcaccggcgcggccttcacccggttgccggtgaagacggcggccgcggtgtagtccggtccgtcgttgacgacgagggcgacatccgggtttccgctggtcttgagcccggcggcgacgccggaggcgcggaagccccgggggtgggtgacggtcacggtgcaactccgaagacgctgaggccggccgtctccggcaggccgaacatgatgttggcgttctgcaccgcctggccggcggcccccttgccgaggttgtccagcgcgctgaccacgatgatgcggccggagtcgacgtccaccgtggcctgcaggtggcacgagttggagccggcggtggccgcggtgtgcggccagacgccctcgggcagcacgtgcacgaacggctcgtccgcgtaggccgcctgcagcgcctcacgcgggtccccgccgttgcgtcgtttcgcggtcaccgtggccaggatgccgcgtggcatcggcgccaggatcggcgtcatcgacagcgagtcggcaccggtggcctgcttgatctcggcgacgtgctggtgcgcgccgaccttgtagggcgacaggtcacccatgatctcgctggccagcaggtgcgccttggcgttgcgcccggcgcccgaggtgccggagctggcgaccaccacgacgtcggccgggtcggccacgcccgcggcgatcagcggggcgagcgccaggatgatggtggccgcataacaacccgtgttggccacccggttggcggcccggatcgccgcgcgtgcgccgggcagctccggcaggccgtaggtccaggtgccggcatgcccgccgccgtagtagcgggtccactgctcggcgctctccagccggaagtcggcgcccaggtcgacgaccttgacaccggccggcagctgtcccgcgacagccgccgactgaccgtgcggcagggcgagaaagaccaggtcagcgtcgccgagcgtggccgcgtcggtgctgccgagagtcaggtccagcccggtgagctgggggtgcaccgacgtcacgtgctgaccggcctggctgtgcgcggtcgccgcgatcaggtcgaactcggggtgcccggcgagcaggcgcagcaactcgccgcccgcgtaaccactcgctccagcaaccgcgacccggattcccataactacctccgcatgactatgcagagaaccgtatcaactcgcattgcgcggggcaaccgtgtcgtgcccggagtcaccttcgcgcgcgaggccgctccgctgcggtgttttgccgtattccgcgacgttcgcgtggtggtgctcccgcctcccggcatctctgccgggcccgacaccgggcgggatccatcgcccgcagccgcgcgggatccgaccgcggccgtcggtatcggcgacgcgtccggcccggccggtcgggcgcatggaacctcagccgcctcatcccatcacggccgggctcacttcgtgtcgatgcgacccgccgggtcgggcgtggcccggacggcgtcgacctcggtgtgccacgccgtggcgtcgatgcccagcgccgtgcgcaggaacgcggtcgaggcgcggcggatcagctccacccgccgcgggctctcgtcggtggtgtcggccgcgcggtagccgtggatgccgcccagcagatgctccccgccgaacactgtcagcagaccctgcgcccccggactgaggtggtagacgtcggtgaaccagtccggcccgcgcgtcgagagcgccgactggtccgcgtcacccgccacgaccagggtcggcgtcttcagcgtgtcgaagtccgggttcatgaacgagaagtgctcccgggcgaacggggccagctggtccccgccgagcccggtggtggccagcaggacaccggcgcggacccggtgatcggtccggtccgcgccgggccggccgtcggcgccgaggacgcgggcgccgaggagcatcccggcggactgcccgccccaggagtggccggcgacggcgagacggtcgtgggcgacccggccggccagtccgggcaccgcctcgacgatcggggcgaggtcgtcgatgacccgactcaggtcgtcgacccgggtctgccagatggtcggatggcgcggatcggccggggtcacgccgagcgtcgccgaatccaggaaggtgggctggacgacgacgaaaccgttcgccgcccagtggtcgacgagcgggtcgtaccagtccatcgcgccgccgaaaccgtgcgcgaacacgatcaccggcaggccggtgccggcggccggtgcggagacccgcacctgcaggtcgtcaccgcggccgggtgcgggcaggacgacgggtttcagggacaggatcggcatggtggctccttcgggggccgccccggaccggagcggcgttccgtttcaccgtacggagcgacgctccgtttcgcaagggcgaggggagcattgctccggttggctgttcggcatggcacaatcggggggtgagcaaggaatcgggaggcgcgccgccgagacgccgggcggatgtcgagcgcaacgagagcgcgctggtcaccgcggccgccgaggtgttcgccacctccggtgtcgacgccacggtccgcgaggtggccgccgctgccggcgtcgggatgggcacgctctaccggcatttcccgacccgggcggccctgatggtggcggtcttccggcaccagatcgatgcctgcgccgaggccggcccgaccctgctcgccgccgcgcccaccccgttcgccgccctgctcgactgggtccacctgttcgtcgacttcctcggcaccaagcacggcctggcgaaggtgtggcagggcgacgacgccggtttcaccgagctgcaccagctctttctcgaccgcctggtcccggtcctgtccgagctgctgggggcggccaccgcgtccggcgaggtggtcgccgacatccggccctacgagctgatccgtgccgtcggcgacctggtcgcctggaccgtgcaggaccccaactacgacgtccgccgcatcgtcacgctgctcgtcaccggcctgcgccagatccagccggagcgttccgggccgtccggcttcgatctcgtccaggtttagggcatcggcccagccgggacggccggaatctccggcactttcgcggagccggatagttgctggccagccctatgctgcgggcatggacaaccaggcgcggaagctctcgaccgggtcgaccgtcggcgggcgcatcttcggggccgccttcggcctcgtgttcgccggcgccggcgtgttgttcgccgcggcggacgtgttcgccgattcgttcgacccgttccgggcgatgtcggactgcgtgacgtccggcgacgtcgccgggattccggccgacgcgctgccgtccggcgtcaccacctgcgactggctgcacgagggcctcaccgccttccagatcgccggcctgctggccggtggcctcttcgcgctggtgggcctgctcatcgtggtggcctcggtgcgcgggtcggcggcctggctcgacgggtcgaggctgcgggtccggcgaaccttcggcacccgcgtcgtcgacctggcgacggcagacgtcaccgccggcatcgtcacgcacaccgacagcagcgactccgggccggtgcgggtgcggcgggtgcccaccctggtggcccgcgagcccgccaccgggcgcaaggtgaccctcgcgctgcagggcatcagcctggaccgcctgccaccggtcgagctccgggcgctcgccgacgccatcgtgatcggccggccggagtcggatgtggacgcgttccgggtcgccgagcagctgcgagcgatggcggacgacccgctggagctgcatcggcattgagcggccgggtgacccgtgggcagccgcatcggcacccggcggggcttgccccggtcgggcaggatggccagggtgagtcgtcgcgtcgtgccgttcatcgccctgggccttctcgccggctgtggtcatgccgccgagacctcctccggaacggtggcgacaccgacgcccccggtatcgacaccctcgtccgcccaccccggctcgcggtgcccggcggagggcgtccgtctggagctcgacgagggcgacgccgcgatgggcctgcgggtccgcggcatcaccctggtcaactgcggttcccgcacctatcggctgaacggttacccggtggtgcgtgcactcgacgaggaccgcgcgccgctcgaccttcaggtcctgcagggggtcacggagatcgtcggctccagcatgccgtgggacggtccgccgcggccggtgacgttggggccgggtcagcgtgccagcgcggcggtggcctggcgcaacacctacgacgacatccgcaagcccccggtcgatgcgaccttcctgcggatcgagccgctcgccggccgcccggcccagaccgtcgaggcggacctcgacctcggcagcaccggccgtttcgggatcagcccctgggtggcggttccggacaccaccgccgcgccggcctcgtcgccgccggctccggccccgtccgacccggtcgcatccgacatcccgctgccgtgacccggcctcggaaagcgtccggaagcgcgcggatgacggcgtgccgatcagcggatccgtgacgctcgcgatcgtcgcggtggtgagcggatgcgatgacggcgccaccgtcgccaccgccgatgcagccgaggcttgcggatgatccgagcggaaaaggcaagatcaacaacaaaatcccgattgcgccgtacgacggtcgcccacccgccgcggcgaaggaaaagcgtgcccgccgggcgaagggaaagcgtgcccgccgcggctaaaactgagcgtgcccgccgcggcgaagacggaacgtgcccgtccccaagaagcaggggcgacggcgaacgaactcagatcgcctgcccggaaataaacggcaaccatcccgcataccaccccgagagcaacgccaacgcccccagcacgatccccagattccggttcgacgcgcgcgccagcagcatcgccgggatcagcagcacggggaaggccggcatcagatgccgcccgatcatcgagatgtgtgtgctggtcccggcggccaggacgagcatcgccgcggtgtagacggtcaccggccacggcacccggccggccagcagcaccagcagcacgatgaatccggcgaggaacagcgccgacatcacccggatcggtttggcggcgttgtcgtcgtccacgccgagcaggatgtcgctgaccatcttcccggtgttggcgccgtggtcccagcgtgccccgaacgtgttcgcgtggatgctggtgtattcgtcgaagccgccgaggcgcgccgaggcgaaggtcaggtaggcgatcagcccggccggggccagcacgatcgcggcccagggtcgccagccgtcgcgccggcgggcggcggcgatcagcgcggccaggccgacggtgccgatcagggccgcggcggtggggcggctcaggccgctgaggccggcgagcgcaccggccagcagccagcgtctggtgagcacggcccacagcgcccaggcggcgagggcggtgaacagtgattcggtgaacgcgccgttctgcgtcatggcggcgggggcgaccgcccagacgccggccagcatgagcccggtccggtgatcgcggatcagccggccgacggcatagatgccccacgccgcggcgatcgccgagatcagggagacgatcaggcacgcggcgaccgggttgacgaacggcaggaaggtcaacggccgggccagccacgggtagagcgggaagaacgccagccgcagctcgtagggcacgccgtcggcgtcgaccgcgccgaccgggccgcccagaccgctgccggcgatcttgatataccagcggccgtcccaggagagcagcgcgtccgccgcggaggtgaagctgcgccactggttgccgatcgacccgtccgggaagacctggcggccgggggagcggctgtgcgcctgggcggcgagcgcgtacatcacctcgaggctgagcacgcgcagcaccacgtagagcccgatggcggacaacgccccggctcgcggacccggttcggtgccggctggtgcgcggggagcgcgttcggtcacggcttccgcaagggaaccgggttcagccacgggagcgcccccacagagacggatcgatggaaatcgttgtggagcgtaacgcaagccggcaccgccgagggcggggttcccggagaaaccccgccgtcgcgggggatcagcgcgggacggccttctccaccgcccactgccgccaggtgtccagtttgtgttgcaccgtggcgagttggtcgcgcaccgggcccggtccggtcgagccgggcgtggtgcgggcggccagggccgaggacaccgacaggacctcgcgcaccgacgggtcgaggtgctcgctcaccgtcttcagatcgtcgtcggtcaggtcctccagctcgcactcccgggccgagcagagcgccaccagcttgccggtgatctcgtgcgcgtcgcggaacggcacgccacgccggaccagccagtcagccacctcggtggccagcgagaagccgaccggggcggcggccgcgagccggtccacccggacggtcatcgtggagatcatcccggccagggcggggagcagcagctccagggtgtcgaccgcgtcgaaggccggctccttgtcctcctgcatgtcccggtcgtaggtgagcggcaggcccttgagcatggtcagcaccgcgaccaggccgccggtcagccggccgctcttgccccgggccagctcggcgatgtccgcgttcttcttctgcggcatgatcgaggagccggtggcgaacgcgtcgtccagctcgacccacccgaactcggtggaggtccagaggaccacctcctcgcccagccgggacaggtgcacgccgatcagcgcggtgatgaacaggaactcggcgacgaagtcccggtcggcgacggcgtccatcgagttcggcgcgggggcggcgaaacccagctccttggcgaccgcggccgggtcgagcggcagtgacgagccggccagcgcgccggagcccagcggactgatcgcggtgcgcacgtcccagtcgcgcagccggtccaggtcgcgcagcagcggttgcacgtgggcgagcagccagtgcccgaagctgaccggctgggcgtgctgcacgtgggtcatcccgggggccggggtgccgacgttgcgggccgcctgctcggtgagcgcgtcggccagctcgatcagcgcgacggccaccccgcgggcgtgatcgcgtaggtagagccgcaggtcggtggccacctggtcgttgcgggagcgaccggcgcgcagcttgccgccgagcgcgccgaggcgctccagcaggccgcgctccagcgcggtgtgcacgtcctcgtcctcgatcgtggggcggaactcgccggtggtgcaggcctgctccaggtcgtcgagggcggccagcatccggccgagctcctcggcgtcgagcaggccggcgttggccagcacgcgggcgtgggcccgggaggcgagcaggtcgtacggcgcgagacgccagtcgaactggacgctgacgctcaacctggccagggcctcggccgggccgccggcgaaccgggcaccccagagccgggtcggctcgtcactctccggcacacccactccttgatcgttcgggacttaccgctgactttaacgcctgcataataatacctgagatctgataaagttgcatcatggctgatcttgatctcaccggcgacgtggtcgccctcacccgggtggtctgcgacatcccctcggtcagcggcgacgagaagcggctcgccgacgccgtcgagagcgccctgcgcgcgtatgcccacctggaggtgctgcgcgacggtgacgcggtggtggcccggacgagcaccggccgccccacccgggtcgtgctcgccggtcacctcgacaccgtgccgatcgccggcaatctgcccgtcgtcgaggacggtgacgtgctgcgcggtcgcggcaccgtggacatgaaggccggcgtcgccgtcatgctgcacctcgccgcgaccctgaccgcgccgcgctacgacgtcacctatgtgttctacgatcacgaggaggtcgccgcccggctgaacggtctcggccggctggtccgccaccatccggagtggctggccggcgacttcgccatcctcggcgagcccagcgacggcacggtcgagggcggctgccagggcaccatgcgggtgaggatcgccgtcccgggcgtcgccgcgcacgccgcccgctcctggcggggcagcaacgccatccacagtgccggcgccgtgctcgacatcctgcgagcctacgagccgcggcagccgatcgtcgacggtctgcagtatcgggagggcctgaacgcggtcaagatcgagggcggcatcgccggcaacgtcatccccgacctgtgcaccatcttcgtgaactaccgcttcgccccggaccgcgaccccgacgccgccgagacccacctccgcgaggtcttcgccggcttcgacctggaggtcaccgaccgcgcacccggtgcccgccccggcctcgaccagccggccgccaaggagttcgtcgacctagtcggccgcgaaccgcaggccaaactcggctggaccgacgtctcccggttcgccgccctcggcatcccggcgatcaattacggccccggagatccgctgcaggcccacaccgacaccgagttcgtcccgattcccgagatccacaccgccctcgagaacctgaaaacctggctgaccgcctaacccttatttcgtacgtcatgagcacggtggcaccacgccccgccccgtcgcgtggtgccaccgtgctcagccccgctcagcagcgtcccgccgcgccgtgccacccgatgcagcagcgccccgccgcgtggtgtcggcccttgccgcccccgtttggcggctcctcagcaaactgaaccggttccgccaccaaccgctgcaagaaccgagcagagcctgcccgataagtcgtgaaagcgaacagagcaaccgcgcgggcgattaaccggttcagaaaaatttgtgatttctatcactttctcggcatgaccggatctagcagcgactttctcagcgctcagtgaccgcacccgcacgcgcagcgccggatgggccgcttcgcgcgcggattcttgccagggatgctcgcggacggcagggaaatcgccgcctcttgcagcgccggccatgccacctgcgtggacgtcggccgctcaaaagaggccgagaacacgctctctcgctcgctaccgcgcccctgtctgacggattgcgcaagaagttgcagcaagtttcccgggcggtgcgggtcaggcagccgaggcgtcggcggtcagagcgcggtgtgccggcgccatcgcggtcgagctgcggaccaccagctcgggccggaaaaggtactctgacctgggcgagccatggccgttgatgtcgtacacgagggaccggacggcggccaccgccatcgccgcgaccggctggcgcagggtggtcagcggcgggtcggtgaaggccatcagcggcgagtcgtcgaaaccgatcaccgacacgtcgtgcgggacccgcatgccgcgccggcgagccgcccggatcgcgcccagcgccatcatgtcggagccgcagatgatgccggtcgcacccttgttgagcagtcgctccgcggccacctcgccaccctcgacaccgaacagggtgagctcgaccaggtcgtcggcgtcggccgccgggacaccgagctcacgctgcatggcggcccggtagccgtcgagtttgcgctgcaccggactgaaccggtggggaccggagatcatcccgatccggcggtggccgagcgaggccaggtgacccaccgccaggtcgccggcgagctgctcgtcgcacgacacgaacggcgcgtcgatgccgtcggtgtgcccgttgaccagcacgatcggcagcgggcgggcgagcaggcggtgatagcgctcgacgtccatggtggtgtcggcgtgcaggccggagacgaacacgatgccggagacctgccggtcgagcagcatctccacgtactcgtcctcggtgaccccgccgggggactgggtgcagagcaccggcgtgtatccgctctgggccagcgtggactcgatgacctgggcgaacgccgggaagatcgggttgtccagctcgggcacgaccaggccgaccaggccggcgctgcgtttgcgcagccgctcggggcgctcgtagccgagcacgtcgagggcggtgagaaccgcctgccgggtttccggggagacgcccgggcggtcgttgatgacgcgagagaccgtcgcctcgctgacctgggcttgacgggcgatgtccgccatccgtgcacgcatgttgtcactgtagtgccgagccgttaccggccatcagcctgcaagcccttccattgactgcaagagcttgctaacgtcccggcaacaaggacgacaccttaccgatcttgtgggcgccgagctatgtccgggcccaagacaccccttttaacgcgctaatccgtatctgacgggagtattttcatgcgcatccgcaccgccggcgtcatcgcggcgagcatgctctgcctggtcggcgccgccgcctgtggcgacaagaagaccagcacctcggccggccccaaggccagcgccgccaccggcgagctgatcatctgggccgacgacaagcgctccgccgcgctcaagccgttcgccgacaagttcggccaggagaacggcgtcaccgtcaagatccaggcgatctcgaaggaccagcagaccaccttcctcaccgcctcgcagcagggcagcggcccggacgtgatggtcggcgcgcacgactggatcggcaacctggtgcagaacggcgccatcgacccggtgcagctgtccgacgcgcagaagagtggcctgcagccgggcgcgctcaaggcggtcacgttcaacagccagacctacggcgtgccgtacgcgaccgagaacatcggcctgatccgcaacaccgacctcgcgccgaccgcgccggccaccatcgaggacgtggtcgcgcagggcaagaagctggtcgccgagaagaaggcgtcggaggtgctctgcctgcagtccggcccgaccggcgacgcgtaccacgcctacccgctgtacgcctcggccggtggctacctgttcggcgccgccggcaacggcgacctggacccgaaggacctgggcgtcggcaagcccggctcggtcgccgcgttcgagaagctgcgcgccttgggcgagaagggtgacggcgccctgaagcgctcgatcagcccggacaactcggtcgccaccttcaccggcaagaagtgcgccttcctggtctccggcccgtgggcgaccgcggacgccaagaaggccggcatcaactacgacatcaccgcggttccgccgttcaagggcggcaaggacgccaccccgttcctgggtgtgcagaccttctacgtcgcggcgaagggcaagaacaaggcgctggcccaggagttcgtcaccaactacgtgaccaccccggagctggccgtcgcgctctaccaggccgacccgcgtccgccggcgctgaccagcgccctggaccaggtcaaggcgaacgacccggacgtggccaagtgggccgaggccggtaagaacgccattccgctgccggcgatccccgagatggccgccatctgggagccgttcggcaaggccgaggccgccgtcatcggtggcgccgacgccaagtcgacggtcgacgccgctgccaagaccatctcggccgcgatcaccaagtaatgacgacgcagctcgaagggcccgccgcgacgcgggcccttcccgcccccgaggccgaagtggaaaagagcagttcgctgcgcagccagagcatcaagatcgtgctgctgggcctggtcgtggcaatcgcggtgtgggccgccttcccgctggcgggcggcgagcactggatcgggctgggcatcctggccgcgaccaccgccgggctgctctacctgtatctgtcgccgcggcacatcccggcgaagtacctggtgccgggcaccatcttcctgatcatcttccagatcttcccggtgctgtacacggccggtacggcgttcaccaacttcggtgacggccaccggggcaacaaggctgaggcgatcaccgcgatccagaccgcctcggtgacccgggtgcccggctccaccgaataccagctcaagatcctggccaagggtgaccagctggcgttcctgatcaccgacccgaagaccggcaaggtctcgctcggcgacgccggcgggctcaagccggtcgacggggtgccggccgggtacaccgtgctcaacgccggtgaggccagcgcgcgcagcagggagatcaccgatttcgcggtgccgaccgcggcgggcgcgatccgctcggcggggctctcccgggcgtacgaaggaaaggctgttcgcgcctttgatccggcgaccgacagcatcagggacacgacgaccggcaaggtgtggaaggccgacgacggtcagggcgcgttcgtcgcgaccgacggggaacgcctggcgcagggctggaaggtcaacgtcgggttcgccaacttcacccgggtgctcaccgacgacaccatccgctcgtcgttcgtgggcacgctgatctgggacttcctgttcgcgatcggctcgaccggcggcaccttcctgctcggcatgttctgcgcgatcgcgctgcagtcgacccggatgcgcttccgcgggctgtaccggatcctgatggtgctgccgtacgccatgccgtcgttcgcgatgctgctggtctggcgggacatgttcaacaccgacttcggcctgatcaacaacgtgctggggatccacgtcgactggctcggcacgccgatcaccgcgcagctggcggtgctgctggtccagctctggctcggctacccgtacatgttcctggtgaccaccggcgcgctgcaggcgatcccggccgagctgaccgacgccaccaaggtggacggcgccggcccgttccaggcgttccgggcgatcaagctgccgttgctgctggtcgcgctgaccccgctgctgatctcgtcgttcgcgttcaacttcaacaacttcaacgcgatctacctgaccaccgagggcggcccgttcccggccgacaatccgaacagcggcgccaccgacctgctgatcacctacacgtaccggctggccttcggtgggtccggcgcccagtacggcttcgccgcggccatctcgatcttcatcttcctgatcgtggcggtggtctccgcggtgagtttccggcgcacccgggctcaggaagaggtgtactcatgaccgcgaaatggttcaaggacaccggctggcggcacctcgtcgccgtcctcgcggtggtcttctcgctcgggccgatcctgttcgtgctctccgcggcgctgaacccgctgggcacactgtcgtcgagcacgctgatcccgagcggggcgtcgctggacaacttctcccggctgttcaccgacacgaacttcccgcactggttcctcaactcggtgatgatcgccgggctggccagcgcgagctcgatcttcctgtccgcgctcgcggcgttcgcgttcagccggcgacgcttctccggccgtcgtaccggcctgctgttcctgctgttgatccagatgttcccgcagttcctggccgtggtggcgctgttcctgatcttctcgacgatcaccgacctgtggcccgaaatcggcttcaacacctggtggggcatgatcctgctctatctgggcggcgcgctgggcgtgaacacctggctgatgaagggcttcttcgacaccgtgccgaaggagctggacgagtcggccacggtcgacggtgcctcgcacaccgggatcttcttccggatcctgctgccgctggtctcgccgatcatcgcggtcgccggcctgctcgccttcatcggcaccatcaacgagttcctgctggccaacctgttcctgcgggacggcgcctcgaagaccctggcggtcggcctgtacggcctggtccagggctcggaccggaacaccaacttcggcatgttctgcgccggcaccctgctcaccgccatcccgacggtcggcgtcttcatgtatctgcagcgctacatcgtcgagggactcagcgcgggcgcggtcaagggatagttatctccaccgattgatgaccagagaggcatactgtggcagcgagtaagacgcggtgggggaccgcggtgctcagccttcttctcccacttctgaccgtcccggctgccgaggcgtccgccgcttcgaatgagcccagcgcctcggtgatcgccaactgggggtccgacaagccggcgagcaacgagcagtactacttcgtcctgccggaccggttcgccaacggcgagaagtccaacgacaagggcggcctcacgggggaccggctgtcgaccgggtacgaccccgccgacaagggcttctaccacggcggcgacctcaagggcgtgatcgacaagctcgattacatccaggggctcggcaccaccgcgatctggctcgcgccggtcttcaagaaccgtccggtgcagggcaccggcgccgacgtgtcggccggttaccacgggtactggatcaccgacttcacccaggtggacccgcacttcggcaccaacgcggacctcaagaagctggtccagctcgcgcaccggcgggggatgaagatcttcctggacatcatcgtgaaccacaccgctgatgtcatcaaaaaccgggagaacaagtactcgtacatcgacaaggcgacctcgccgtacaccgacaccgagggccagccgttcgaggacaagaactacgcgaccggcaggaacggcttcccgaaggtcgacgcgacgtccttcccctacacgccgaccgtcgacccgaaagacaagaaggtcaaggttccggcgtggctgaacgacgtcacgatgtaccacaaccgcggtgactccaccttctccggcgagaacagcgagtacggcgacttctacggcctcgacgacctgtggaccgagcgtcccgaggtggtcagggggatgaccaggatctacgccgactggatcggcgcgaccggcatcgacgggtaccgcctggacaccgtcaagcacaccgacctggacttctggccgcagttcacggccgggatcaaccaggccgcggccaaggccggcaagccgggcttcttcatgttcggcgaggtgtacagcgccgaccaggagatcgagtcgacgtacgtccgcaagggcgggctgccggccaccctggacttctcgttccaggccgccgcgcaggcgttcgtcaccggaggcggcaccgcggccgggctctccgacgtgtacgccaaggacgacctctacaccacgccgaccaccagcgcggagcggctgccgaccttcctcggcaaccacgacatgggccggatcggctcgttcatcgccgccgcctcgaccgccgacacccagctcaagcgcgacgagctcgcgcacgagctgatgttcctgacccgcggccagccggtcgtctactccggtgacgagcagggcttcaccggcccgggcggggacaaggacgcgcgccaggacatgttcgccagcaagaccgcggactacctgaaggacgacctgatcggcaccgaccgcacgcacgcggtggacaactacgacaccgcgcacccgctgtaccggacgatcgcgtcgctggcgaagctgcgcaaggcgaacccggcgctggtcgacggcgtgcaggtgacccgctacgcggcgaccggggccggtgtcctcgccgtctcccggatcgacaggacgaagcggaccgagtacgtggtggccgccaacaacgccaccaccacccagacggtcagcttcgccacctcctcgcccggggccaccttcaccgggatctacggcggggcggccccggtggtcgccggcgcggacggcaaggtcaccgtcacggtgccggccctgtccaccgtcgtactgcgctccaacgctcccgaagccgtgccggcggccgcgccgaccgtgaccctgaagccggccgccggcgccaaggtcgcgacccggaccgagctgaccgccgagaccaccggcgacccgctcgccacggtcaccttcgcggcccaggtcggcgacggaccgtggaagctgctgggcaccgccgacagggcgccctaccgggtgtatcacgacctggacgggctggccggcggcaccccggtgaagtacaaagcagtggtgcgggacagtcgcggacgactcgcttcatcgtcgacgagcatcacggtggccacgccgacgccggcctccacggtgggctacgcgatcgtgcactaccagcggccggccggcggctacgccgactacggcctctacacctggggtgacgtggacccgtcgatgtcgacctcgtggccgaacgggcagccgttcgtcggcgaggacgcgtacggccggttcgcctacgtcaagctcgcgccgaacgccaagagcatgggcttcatcgtggtcggcaaggacggcgtgaaggacaccgacgcggaccggtcgctggacccgacgaagaacccggaggtctggctcaaacagggcgatcccgccgtctacaccacgccgcccgcggtgcagcaggaccagggcaaggcgatcatccactggcgccgggccgacgggaactacgacggctgggggctgcacgtctgggacggcgccgcgaccggcaccgactggggcagcccgctcaagcccacgaagatcgactcgtacggagcgacgttcgaggtgccgctggccgacggcgccgccgggctcagctacatcatccacaacggcgacgccaaggacctgccgaccgatcagcgcctcaccttcgccgacgcgggccacgaggtgtggctgctcgccgggcagcaggaacgcctgctgccgctggtgaagacggccggcggcaccggatccaccgatgtcaccaaggagtcggcggtctggatggaccgctcgacactggcctggcagaccggtggcagcaccgacggcaaggtctacgacctcgtgtggtcgccgaccggcgggatcggcgtggcgaacggcgagctcaccggcgactacaagaccgtgtcgctgcacgcgaaggggaccggcctcaccgagaggcagcgggaccggttcccgcacctgtggcagtaccgcgccttcaccaccgacgcccggaacgtggcggacatcgtgcgaggccaggtcgtggtcaccgagcggaacaccgacggcagactgctcgccgcgaccggcgtgcagaccgcgggcgtgctcgacgacctctacccgaaggcggtcgacgccgagctcggctacctgcacggccgggtcgcggtctgggcgccgaccgcgagcagtgtcgagctggagacctacgacaacgcgacggcgtccagcgcgacgctggcgaccatgaaacgggatgaccggaccggcgtctggtcgctcccggtggcccggggcgactacggcaagtactacaggttccgggtcaccgcgtggcagccggccgcgcagaaggtggtcaccgcctcggtcaccgacccgtactcggtcgccctgtccaccgactcgaagcggagccggttcctggatctgaacgacccgaagctggccccggccggatgggacaggctgcgcaagcccgccgccacggcgccggcgaagatccagatccaggaattgtcggtacgggacttctccatcgccgactcgtcggtgcccgccgccgagcggggcacgtacgcggcgttcaccgaggcccgcgcggccggggtgcggcatctcgcggatctcggcaaggccggggtcacccacgtacacctgctgcccgtcttcgacttcgcgacggtgccggagaaccgggccgaccaggcgcagcccggctgtgacctggccgcgctgccggccgactcggatcagcagcaggcctgtgtggccaaggtggccggctccgacggctacaactggggttacgacccgctgcactacaccgtcccggagggcagctacgccgtcgacccggcggaccggacccgggagttccgctccatggtggccgggatcaacaacgccggcctgcgcgtggtgatggacgtcgtctacaaccacacgtcggcggccggcaccgacccgaactcggtgctcgaccagatcgtgcccggctactaccagcggctgctcgccgacggcacggtggccgactcgacctgctgcgccaacaccgcgccggagaacgcgatgatgggcaagctggtcgtcgactcggtggtcacctgggccaagcagtacaaggtcgacggcttccggttcgacctgatgggccaccacccgaaggcgaacatcctggccgtgcgcaaggccctcgacaagctcaccctcaagcgcgacggggtggacggcaagaacatctacgtctacggcgagggctggaacttcggcgaggtggcgaacaacgcccgcttcgtgcaggccacccagcagaacatggccggcaccgggatcggcacgttcaacgaccggctccgggacgcggtccgcggcggcggcccgttcgacgacgacccgcggatccagggcttcgcctccggtctggccgactcgggcaccgacaacgcccggctgctgcactaccaggacctgatcaaggtggggctgaccggcaacctggccggcttcgccttcaccgggaacgacggcaaggtcgtcaccggtaaggacatcgactacaacggcgcgccggcgggctacaccgcggcgccggacgaggcgatcacgtacgtcgacgcccacgacaacgagatcctgtacgacgcgctcgcctacaagctgccgcagagcaccacggcggcggaccgggcccggatgcagtcggtggcgctggccaccacggtgctcgggcagggtgtcggcttcgtggcggccggcagcgagcggctgcgctccaagtcgctggaccgcaactcgttcaactccggcgactggttcaacgcgatcgagtgggactgcaccaagggcaacgggttcggcaagggcctgccgccggccgcggacaaccaggcgaaatggcagtacgccaagccgctgctcgccgacccggcgctcaagccggactgcgcggcgatcaacctggccgacaaccggtatcgggagctgctccggatccggacgtcgtcgccggtcttcggcctggcgaccggcaagcaggtgcagcagcgggtggcgttcccgctgtccggcaagaccgagacgcccggcgtgatcacgatgacgctggacgcccgcggcctcggcgggaagtggaagtcgatcaccgtggtgttcaactccacgtcggcgaccgcgacccagacgctgcccgccctggccggtaagaaggtcgcgctgcacccggtgcagcaggcctcggccgacccgctggtgcggaccgcgtcgttcgccgcggcgaccggcacgttccgcgtcccggcacgtaccgtctcggtgttcgtgcagaactgacactgatgggctgccggccccgctcacccgatcagcccgggagggcggggccggtttcagttctgcaggaccggagccgacagccggtcctggagctgggcgaccggctccgggcggcccaggtggtagccctggacgaaccggcagcccatcacggtgagcaggttgagctggtccgcgtcctcgatgccctcggcgaccacccgcaggcccagcgtgtgcccgagctggatgaccgcgttgaccagttcctgctggcgcccgttgccggccatcccgtcgatgaacgagcggtcgatcttgagcacgtcgaccgggatgtcgcggagatagcccagcgacgagtagccggtcccgaagtcgtcgatcgcgatcttgacaccgagctcgcgcagttcctccagccgggcggcggtcaccgccaggtcgcgcatcagcaccgtctcggtcagctccagcaccaggcagctcggggccaggccggtcgccgagagcgcgtacgccacctggtcggtcaggtcgggcatctccaggtgggtggcggacaggttgacgctcacccaggccggcgcggtcgccgggtcgtcggtctgccactgcttgaccgaccggcatgcctccagcagcacccaccggtcgatctccacgatgatcccggtctcctcggccatcgggatgaacgagccgggcagccgcagcccaggtagccgatcagcagcttgcggcgaacacccacctctcaacgatcggccggaacccggatcatctttgcggcgccggggtggcacgtcggcgttgcgccgcgtctcctgcccggcgagcgcgggagccgggtcagaccgcgacggtctcgcggtgctgcggcccggtggcggtcgtccgcctcctggcgcgcagccccaggccgatcgcgaccagcagggcgccgccggtgatcacgccgaccagctgtgcggagaggtcgaacagcttcagcgagctggccagcagcacgatgatcagggcggagcggaccaggccgcccggggcccgcgaggagatccgcgagccgatcagcacgccggggatcgagccgagcaccaccgcgccggcgatgtccaggtgcaggtcgccgaagagggcgtgccccagcgcggccgcggtgaccagtggaacggcctgcaccaggtcggtgccgaccaggtcgttggcgcgcagcttcggatagacggcgagcagcgccacgatgatcagcgagccggagccgaccgaggtgagcccgaccaccaggccgcccatgatgccgatcagcagggtgggcagcggccgcacggtgatcgcggcgggcggggcgtcggcggtgcgccggctcgcccaggccttggcgaccatgccggcggcggccagcagcagcgccgccccgagggcgatcttgacggtgtgctggaccgccctgtcgtcgccgagcaggcgcagcagcagcacgccgaggaaggcgctgggcacgctgccggcgcagagccagccgacaagcttccagttcaccgtgccgcgcttggcgtgcaccgcgccgccgaacggtttcatcaccgcgctggccgccaggtcgctgccgatcgcggcgaccgggttgacgtggaacagcagcaccaggatcggcgtcatcagcgcgccgccacccatgccggtcagtccgacgatgatgccgacacccagcccggccagcgccatggtgagatccatggccggaagtctgcctccggataacccaccttgtctactaaatcagttgagtttatcgagattcccgacggctgggatccccgagcagcggcgcgatgtcctcggccggcatcgggcgggcgaagtgaaagccctgggcgaaccggtaaccggccccgccggggatcagcaccgcggcggccgggagaccggggccgtcggtccggcgccacgctggggcccccattgatcggaggattcggcggttcgcgcaggactcttcagttgccggcacggttgccgatcgggacggccgtggatgagcttgtgctggagatgctgcgcgacgacctcgaccgccgggtgaccgcggcggccgccaccatggccgacacgctgcgactgctcaccgcggcgcgcgagctggccggggatgccccgggtggcgagtcgctgcgcgcggcgatcgaggagctcaccgcggcccacgcggatctgctggtcaggagtcggtgaacgactcccagtcgaggccgagccggcgcaggcggcgcagcaggccgggatggcggaccccgacgtacatctcgcaccagtcggcgtcgtcctcgccgagcagcaccaccgtgccgggcccggcgtaacaccgggagaacaggcatggccagcgcatcggccgcaacgggacgcggcgcagcggggcgatgatccgctgcgcctgcgggcggtcgacgaacgccatcccgcccagcggcccgtccatcgcggcccgggccagcgcggcgttgagcaggaaaccggcgagccgctcccgctcgggcagcagccggtcgctcagcccgtcgtagaagacctccggatcgtcctcgccgggcggcatcgcgagggtgaacatgccgtcgccctcatgaccgaaggtgatcagaccgtccgggcggtcggccagcggctccggcaggatgcgcgaggagattccgtacacctcgggccgcccggccgccacccggtggaacgcccgcaacgccgtcggctgacccatcggatcgacatccggaacgcggcgggccggtacgccggaataccacgccgtgataaaccgctccatcgcgccggtcgggtcgtggcccaccatgtcgagccactcggggccgggctccagcagaccgggcggcagcgcctcctcgaagcgcaaccggatgtcgtgcagcgccccgcgccggtagccgagctcggcggaccgggccacgcccagtgccaggcagccctgcggcagccgggcgaacgcccgcaccgccggtcgcaacaccccggccaggcgctcctcgaggagttcggggaacggcccgggcagcaccatctcgtcggccccgccacccggggcgatcaccacgacggcgtccggcccgaccgcgtaggcggcgtccgcgccggtgagcagcgtcgcccccggaccggccagggcgagcgcctcgggttcggcgaccaccgaccagagtccgatctccaccgccacacggtagacgccgccggcccggccggctcggacagtgacacagccctcagggatggacgacgtcgtcttctcgcgctgttcggggtccggcgggcgctggcggcgaccgggtcgtggtccgcgaaccgacgaataccggtacgcctcggccgccgaggaggcgccggccgggccggcatgatcggttccggctctcgtttctggcacatccggggcgctgcctgcggtctttccggatgtcggtgggcgcgctcccaggtcagcgggacgtccctgatgtcggcttctgtcccgggagtcgggatgtaacaacgggctaaccgcaagaacaagaagtgaacgtaggctcgacgccaagtaaccgaacgtcgctcccgggctcggtgcggagctacgacccagcggtccggtcgcagtgcgtggccaggaggcacccaccatgcatgatgaagtgctgaacctgatggacgactgtctgaccaagctgatggtgctgcgggccgagctggccgcggcgcggcgcgtccgcctcggcgagcggcgggtggccgtgctgcgggcgatcgatgccgccgccgggttcgccgaggccgcggcgcttgccatcggcgagccggtgccgccggccgtgatcccggtctcgccggccgtcaggcccctctccgcgaccgtcgtgccgatcgtgccggtctcggcaagctaccggtgagttaacttcgggctccgtcgatgaagctccgcggaacatccgccggcgtatacccaagcggtcaccagatttgatacatagaacggcatgactgtcctccctagtgccgcggagcttcccggcgtcccggtcggccgccgcgccgttctgctcgccggcctgaccgccggtgccggcgcggtcgccgcggccgcgctgccctcggtcgccggcgcggccggttccgccttccagcacggtgtcgcctccggtgacccgctcccgggcggcatcctgctgtggacccgggtcacccccacccccgaatcggtgccggcctccggcctcggcccgcaggtggacgtggactggcaggtcgccaccgacgccgggttcgccacggtggtgcggtccggcacggtcagcaccggcccggaccgcgaccacaccgtcaaggccgacatcagcgggctcagcccggccaccacgtactggtaccgcttcggcctgggcggcgagtggtcgccggtcggtcgcacgatgaccgctccggccgccaccgacgccatcgcccggctccgggccggcgtggtcagctgcgccaactgggaggccggctacttcgcggcctaccggcacctggccgagcgcggcgacctgaacctggtggtgcacctcggcgactacatctacgagtacggcaccggccagttcgacgccggcggcacggtggtccgcactgtggccccgctcaacgagacgctcaccctggccgactaccggacccggcacgcgctctacaagacggacccggacctcaaggccctgcacgcctcggtgccgtggatcatcacgtgggacgaccacgaggtggccaacgacatgtggagcggcggcgcggagaaccacaccccggccaccgagggcgacttcgcggcccgggtcgccgccgcccggcaggcgtacgccgagtggatgccggtccggctcgccgcggacggccacatctaccgccggctgcgctacggcgacctgttcgagctctcgatgctggacctgcgcacctaccgttcgcagcaggcgtcgggtgccgtcgtcgacgacgaggaccggaccatcgccggcgccgcccagctcaactggctcaccgacgggctggtcaactccaccgcactgtggaagatcgtcggcaacccggtgatgatctcccgcctcgacgtgctggccctgccggcctggctgctcggcccgctcggcgagctgatcggcgtcccgcagaacggcgtcgtgctcaacgccgaccagtgggacggctacaacgccgaccgggagcgcctcgtcgacaccctgcgcgcgcacgacaccagggacgtcgtcttcatcaccggggacatccacaccagctgggccaacgagctgaccaccaaggacaccggcaccgcccatccggccgcggccgaattcgtcgtcccctcggtcaccagcgacaacatcaacgacgcgctgggcaccagcccgggcgggccgctcagcctgctcgccgccagcctgatccgggccaccaacccgcacgtcaaatgggtggagaccgacgggcacgggttcggggtcctggacatcacccgcagccggtgccggatggactggtaccacctcgccgaccggaccaggaaggacagcgccgccaagtgggtgcagggctggtcggtcggccgcggctccgccaagatccgtaaagagtccgcccccggctgaccggacgggccggccggcgcccgggtggcgccggccggcccggtcccgcggctcagcccagggcgtacgcccgggcgatggtgacctccccgtacgcgccgttgaccgaggtgacccggctgcgcagccagacccgcccgctcatcgcgttggtgaccgttccctgccaggtcgtgccgctgccggtcaccggcatcgacgtccaggtccggccctcgtcgaacgacgccagcagcgtcaccgtcctgatcgcgctcgcccggccgaccgtgatgtccggattcccggagcggcggtccggcaggatctgcaccaccgtggtgccgccggccgtgccctggttgttcaggttcaggccggccggcgccagtcggggcagttgcacgtcggtgaggtacggccgggcctcgggatccaggctgacccggaagatcgcctgcgagctcgacgagagcaggtccgccgggtaggtgatgccgggccggtagcggcgggcgttgacctgcagcgtgtaccagcccttggccgggaccttggcgatgaagccggggtcaccgtcggcccagttctgccgccactgctgcttcaccacccggctccgactgtcggtgagcgtgaccagggaccgctcgctcgcctcgaattcgtcggcgttacccgggtcccggaacatcgtcgaggtgtcgaagttgaggctggcgcccgtcatcatctccggtacgtggtacgccggtccccaggccgaggcgaagaacgtcgtgctggaggtccggcccgccgccacggtcaccttgcgccagtcgaagccgagaccggcggtggcgccaccggtctccaccgccgaccagtcggcgtccagccgccacttcccggcgctcgcgtgcaccttcgcggttcccggggcggggccgccgaacaccccgacgccgtagcccgggtggcagtcgtcgtcctcgtggaaggtcaggccggcctggtcgctgccggccgggccgcgccggacggccgcgctgaccgtgcccagcgaggacaccgcgatcgtgccgtgcaccccggccggcaccttggggtgcgggccgccggccaccatccaggtctcgttgccgccctggctctgccagatcgaggaccaggagaagcgcaggtgggtggaattgttcgagaggacgaacagcttgccgggctggttgtaggcgtccaccttgatcggggcgccggtggcttcggaacagatcgccgcccgcacggtctgcgcatagccggcgcccgggccctggtccagccgcacccccaccggctggccgccgcgggcgtcgatggtcgcggtcaccgccccggccggcacggtcaccatggtggcgcccagcgtgtcggtgccgtcgcgctggttccacatgtcggtgatcaccgcgtacgcccccttcggcagtgccttcgccgagaagctggacgcggtgtaactctggttgctggacaggttgatgatccgcagcgaggtgtggaagacctggcccgaccggtcgtaggtgttgaccgtcaacgttccggacgcggccgacgccgacccggcggtgctcaggagggtgaccggcagcagcgtgacgaccgccgcggccaggagagtgagcctgcgcaatgcaaccccgttcggtgtgatggtggcgcgggatgctagcagtgatccactccggggcggcacccggctgagcgcgcctggtgaccggtgactcaggcccggtgatcggcggctcaggcctggtggtcggtggcccgggccgcgcacaggaacgcgccgccgaccgcgaaggcgcccagcacggccagcgagatctgctgctcgtgatccaactgccggtcataggtggtgcggtccaccacggtcagccggtcgtggtcggccagcacgtacgtgccgtcggcgcggacctccggattgccctgcagcgcgacgaaggccagcacgatcgtcaaccagaagccgaagaagaccaccccggccgcgatcgccgcccagaccggcacgtgcggcggcacccaggacgccagggaccacagccggcgcggctgctgcgtgcggtaggcccgccggttggccagcacgccggccgcgaaacccggcaccgtcaacagcgcggcgatccccaccgcgaccaccttgtccaccggacgatggccgagtgcgagcgccacgaccagggcgcccgcccacagcacgccggccccgcacagcacgctgtaccagagcagcccccgatgcgacatcatcaccgcagacgctagtgcccgcccggccaccgcgggccggtttcggtccaccggcggccggccacgcacgacgtagccccgcgatgcgggtccgggtggcggcgggcggctgctcaccgcgtaccgccgcaatcggattcctcccggggccgcgaccgcaagatctcagcggacccgcagcggcaggtcgtaggtttcgccgcggcgcagcggatgcacgttctcccggcagcgacgcagatagtcgctgagcggcgacttcatcacccggtagtcgtcgtagtggatgggcagcgccaccttcggccggatcaggccggtcagcgcggcgccctgccgcccgtccatggtcaccagcagccccaggatccgggtgccgcccaggtggatgagcatcgcgtcgatctcgccgcagcgctcccggatctccgagaggaacgggcggtgcagcgtgtcaccggtgatgtagatgcgggtcagcggctcgccgtcgcgctcccactcgatcagcgaacccatcacgtcgggcagcaaccggtcgacgaaccccgggccgtgccggccgggcagtgcggtgatccgcagggtctggccggcccgctgccactcggtggcgtcccagaccgggatcccgcgggccgcgtcccagtgccgcctgcgcagccggcgttcggcctgcggggtggtgaggatcggcagatcacgcgggacgctgcggcgggcggcccggtcgaagtggtcgccgtgcaggtgggagaggaggacggcatccaacggggggagatcggcgaacctcatcgccgggtcgatgagccgcctggtccacatcccgtaaccgaggtggacacgactgccggcgtgcccgaacgcggggtcggtgagcagggtgaactcgccgagccggagcagggtggtggcattgccgatgaacgtgacggtggcttgcggtgtcatcgggctcgcatacccggttttctgcggtccacgtctctgctagcctgacaagttgaccgtcaattcttgtgacgggcaaaagcatccactttcagattacgtcacggaggcacacgtgtcaagtctgtcaagcctcgccgaggaacaattccacctcggcgtgctctacggccgtctcgacgagctgcgggcacaggcgcggaatcggctcgacgaagcccggcggcagggcggcggcctgccctcctggcggtcccatcgcgacgccgccacccaggcgtacgccgaacgcctcgcccggtacgacgccgtcgaaccgggcctctgcttcggccgcctccacctgcgcgacggcgacagcctgcacatcggccggatcggcctgcacgacccggaccgggcgctgctcgtcgactggcgcgctccggccgcccgtccgttctacaccgcgaccgcgatcaccccgcaggacgtcaccctgcgccgccacatccgcacccgcgaccgcaccgtagtcgacctcgacgacgagatcctcgacctcgacaccgccaccgaccggtccctggtcggcgaagccgccctcatcgccgccctgaccgccgaccgcaccggccggatgcgcgacatcgtcgccaccatccaggccgaacaggacgcggtgatccgctccgacgccggcggtgtcctcgtcgtccagggcggacccggcaccggcaagacggccgtggccctgcaccgcgccgcctacctgctctacacccaccgcgagcagctcgccgcccgcggcgtcctgatcgtcgggccgaacgccaccttcctccgctacatctcccaggtcctgccgtccctcgccgaaaccggcgtgctgctcgccaccctcggcgacctgtaccccggaacgaccgcgcggcgggccgaaccggcggaggtcgcggagatcaagggccgggcgacgatgccggaactccttgccggggccgtccgggaccggcagcggatcccggagacgccgctggagatcccggtggacgggcatgtcctgcggctcaccgccgcggactgcgtcacgccccgcgaacaggcgcgcgcatccgggctccggcacaatccggcgcggccgatcttcgccgccggagtgctgaccgcgcttgccgggcagatcgccgaccggatcggggacgatccgttctgggatgatccgctgggtggggacgatgcgctggccggccccaacgtcctcgatgaggacgacctggcggacatccgggcggaccttgccgaaaacccgcgggtccaggccgcgctcgactcgctgtggccggtgctcaccgccgctcgactgctgaccgatctgtacgcctcccggccggccctgctctccgccgccaccgaccccccacccgtcgccgcgcctgtcccggtgtccgaagggccagcggacgggggtgggccggtggccggaagactgctgagcgttgccgagtgtgcggcgctgtggcgggagccgggcggcggctggtcgcccgcggacgtgccgctgctcgacgaggcggccgagctcctcggcgaagacgaccgggacgcccgggccgcggccgcgcgggagcagtcgcggcggctcgcctacgcgcagggcgtcctggacatcacggccggatccaagtcgttcgagctggaggacgacgacgaggccgcgatcccgaacgccgccgacatcatggaagccgacatgctcgccgaacgcttccaggaccgggtccacctgtcgaccgccgaacgcgccgccgccgaccgggaatgggtcttcggccacgtgatcgtcgacgaagcccaggaactctccccgatggcctggcgcctcctgatgcgccgctgcccgagccgctccatgaccatcgtcggcgacctggcccaggccggcagtctcggcgcccccaccacctggtcggaagtcctcaccccgtacgtggccgaccgctggcgcctggccgaactgaccgtcagctaccgcaccccggccgagatcatgtcctacgccgaacgcctgctggccaccgtcgaccccacgatcgtcccgcctcgcccggtccgctccaccggcgtggcaccgtgggaagccaccggcaccctcaccgacctggccgcccgggtcaccgccgacatcgacgcgttggccggcggccgcctggccgtgatcgccccggccggccaccaggcagccctggccgccgccctgccggccctcaccaccggcccgtccccggacctggaggatcacgcggtcctgctcaccgtcgcccaggcgaagggcctcgaattcgacaccgttctcgtcatcaaccccgcggagatcctcaccgactcccgccgaggctcccacgacctctacgtggccctgacccgccccacccggaacctcggcgtcttcactctcctaccccgctgaccgcgccacccgctacgggatcggacagcaaggaggcgggccggggtggagagggacggtcagcgggggaggggccgcacggcccgcggtttcggcgtgtggcggcggtaggcactgtccgtcggatcgtcggcgagccagaaacgccagggcacatcatgggccgaggtcacgcccacccggggcccggctgcgacggcgcccaccgcgccggccggcggggtgagggtggccggcccggatccgtcgatgaccgaggtgtcgttggcggcccggtcgagggacagcacctgcatgagcttggccgggccggatgccagatcggtgtcgcggcgggcggcggggcggcgggcgcgggccaggtcgtggccgtcgacgatggcggcggcgcggagcaggaccgcggcggcccggccggattcgccgcagacgatgttcgcgcagtagtgcatgccgtagatctggtagacgtagaggcggccggccgggccgaacatcaccgcgttgcggttggtgaggccgcgatgggcgtggctggccgggtccgcgcccaggccgctgtaggcctcgacctcggtgagccgggcggtcacgccgttggcggtcaggtgccagccgagaagttgccgggccgcctcgtcgacggcttcggccggtaggtccatccacccgtacgtcatcggcccagccaatcacagcgccttccggccgacacgcatgctcccggtgacggacgtgttaccggtcggtatagttcgccgccatcgggacggctggggagcgaacgatggcgcaggggcacaacggggatggcgcgcccgacccggagacggtcgtggcgggggtggccgagtcgcggccggtcgacgcggaggtcatcgaggcgctgcgtgcggccaccgcgcaccgggatggtgcggccgaggtggcggatccggcggagccgtccatcctggacgccgagccggaagccgccgagcccgaagctgccgaacccgaagctgccgagcccgacggcgccgacgccgcgacggtgccgccggaggtcggcggcaccggactcccgcgtaccgccgcgatcgggaaacgctggggcgcgctcatcgccggcgtgctggcggtcgtcctgctggttctgatcggtctggcctgcagcggggtcttcacctccgccgctccgcccaccccgctgccgtccgcggatcccctgaccccgagcgctccgggcagttccggcctgccggccacgccgaaggccgcggtccatccggcccgcaccgccggcgacctggaccaggtgtgcggcgggaccttcttcccggcctcgccgaagtatcagggccggggtccacatccgattctgatcagcgcccgcgagcggctggatctgaccgaccgggcgactcgcacgttgcaccgtttcgccttcgcgggcgcggcgagcggcaagctgacctgggcgccggccgtgccgaaggtgcagctggtcgcctgtctcgatctggccggtccgggtgccaggctccgggactgtccgggtgacacggcgaagtccccgaagctgccactggtggtcggcaggtatcggctgaccgtggtcgaggtggcgaccggccgcaccgtcgcggagtccgagctgaccggggccgggaagtcctgcccgtgggtggcgatgaccggttctgacaagacgctgtattcgtcggtggacgacaaccagctctatcgggcgttgaaagccccggtcgctcaggcgattcccgggtcggcccagccgagaaagcgttcgtagaggtcggcgggcgggccgccggtgccggcggcccagtcgtcgatggcttcgatcatgcaggatccgaggtagaccgacaggccgtgcgagaagtggtggtactgctcggcgagttccactttggcggtggcgcacggccagggacggccgcagacccggcagtcccacgaggggcgttccccgacgtgttcggtgcgcggcaccagcatgtccactccccgtgaccctcaccttccgctgtccggcggctacacatgggagcgtcgcctgccttaggctcgggctcaagccgcagcggcgagaatctcggatttggattctcggcgtctcgatgcagccatccggatcgtctcgttcgagacaccgggaacgcgggcgggccgagccaggaggagagtccggatgtcgacggtacccagacggcaggtcggccggctgctccgacagttgcgcgagcaggccggcatctcgctgatggcggccgcgcaggagctggagttctcccgggcccggatgtaccggatcgagaacggtgaggtcccggtccgcaagcacgacgtgatcgccatgtgcggcgtctacggcgcgcccgggcacatgaccgaggtgctgatcggcctggcgcaggagtcgaaggcgaagggctggtggcacgcgtacggcgatgtcgtcccggcctggttcgagctctacgtcggcatggagcagggtgcctgccggcttcggcagtacgcgccgagcgtgatcccgggcctgctgcagacccgggagtacgcggagttcgtcttcggtcgctggctcggcgacgacccggtcgcggtggagaacgcggtggcggtgcggctggagcgccagtccctgctgcagcgcagtcgcccccgggcgccgcgcctggaagtgatcatcgacgagggggtgttgcggcgcggcgtgccggacaccctgggcatgcagaagcagctcgcccacctggtgaacgtctccacccggcagaacgtgagcgtccgggtcctgccgttcgcggccggcccgcaccaggcgtccagttccggccagttcaccgtgctggagttcccggcggtcggcacggcctccccggaaccgacgaccatctatggcgagaacctcaccggcgcgctctacctggataagctcgccgaggtcgagacgtacgagcggatctggtccgcgctcgacgcgatcgccctgagccagtccgactccgatgacctcatcggcacgatcatcaaggagagcgatggctgacctgtccggtgccgtctggcacaagagcacccggagcggcggcaacgggggtgactgcgtcgaggtggccggcaacctcccgggcatcgtggcgctgcgggacaccaaggatccggacggggcgacgctgatcttctcccgcgagcagtggcacgccttcctggccggggtccgggccggcgagttcgaccaccgggcacgctgactcttatgaatctgtgagccctaccttaagcaatcctttccggtacgccgtgggccgcgacggtcgcgcatagtcggtgggcgtcgtcccctgtccgcgctaccgaggtgaatatccgtgtcgctctccgctgccgcccgtttccgatacacactggtggcgggctcgacagccgtggtcatcggctccggattcatcctgatgggcctcggtggcccggactccgcgcaggccgattcccgctcggccgacgttccgctcgcggccgccacgaccgccaccgccgccgcgaccgcctccccgggcgccgccgtcgagccgtcgaaggccacccccggccggaccgcctccgcgtcccccgcgacggcgcggacctcggccacgccacgtccgaagagcagcaccatcaaggtggcgaccggcaccaccaggtccgactcggcgacggtcctggacgcggtggtggcgcacatcaacgcggcccgcgccgacgagggactgcccccgctgaccctggacgcgcagctctcgaaggcgtcggcgaagcacaacgcgctgatgatcgacggttgcggcctggagcacaactgttccggcgaggccggcatcggcacccggtacgtcggcgtgcagtggcacaccgcgggggagaacatcggctacgcctccacccggagcgaggccgagacgatcgccacggccaacggcatcaccgactcgatgctcgccgaggtggcccccaacgacggtcaccgcaggaacctgctgaacaaggacttcaccaggatcggactgagcgtcgtccgcgacggcaagggcctggtctgggtgacgcaggacttcgtcggctgagttcccggaccgtgatagacatgcgcggtgagacggtccgcggccaagcgtgtcgaggtgctggccgcggccggtgaggtggtcgcggcccgcggcgccgatgccacccggttcgccgacgtgagtgcggccaccggggtcggtgtctccaccctgcagtattacttcggcacccgcgaggacatgctgatcgcggtcttccggcacgccgccgagcgtgacttcgagctggtcggcgagcgtctggccgggctgaccgacccgtgggaccggctgctggccatcgcccggcacctcggcagtgacctctcctggcggctctgggtggagagctggcgctgggcgtcacgggacgccgaggtccgcgcggacgtgctcgccgactacacccggtggcgggagctgatcgcggccaccatcgaggcggacaacccgatgcgggtggcccggcaggtgctcgccctgatcgacgggctcgccctgccggtggtgctcggcgacccggccgtcgaccgggccgccgcgaacgagctgctggaggaggcgttagcccggctgctgggtcgtgccccggccctctagcaggggggtcgaccgcttccaccggggcccgtcgccgtccttgcggcgccgcgccatcccggacagcgcctccagcaccacccggttgccgagcatcgcggtgatctccgcgtggtcgaacggcggggacacctcgacgatgtccatgcccaccacgggcagctcgtggcagatccgggagacgctgtcgagcagctgccgggcggtcaggccgccgggctccggagtgccggtgccgggcgcgtggcccgggtcgcagacgtcgatgtcgaccgagaggaagacgccgtcgcagccgtccagggcgatggcgaacgcgctgtccagcaccgcgtccaggccgcgttcgacgatctcgctcatgtggaacgagttcatccgctggtcggccatccagtccaggatgtccggacccggccagtagccgcgcaggcccagttgcaggaaccggtcgccgcggaccgcgccggactcgatcagccgacgcatcggctggccgtggccgtacagcgagccgaactcgatgtccccggtgtcggcgtgcgcgtcgaagtggatcaccgagaccctgctcgcggcgtgcgcgccggccaccccggtcacgtccggccaggtgacggtgtggtcgccgccgaggaccagcgggatcgcgccgtgccgggcgatgaacccgaccgcctcctcgatgctgcggcagctgcgctcgatctccccgctgaacacctcgacgtcgccggcgtccttgacggtcaggtcggcgcccagcgcgtcgacccgcatcgccatgtgcgggcgggtgccgtcgtgggccaggtagtcggtgccgcggatgacctgcgggccgaaccgcgcgccggggcggtgcgaggtgcccccgtcgaacggcgcgcccacgatcacgacgtcggcgtccgcgtaggtcgacggctcccgccagtcgcaggcggggatgccgaggaacgtgtagtccggcccgaacatcggtccataacgcgtcatggtgtgcatccttcccggctcatcatgtcggcggggactgtatcgccatactgtatggccgtacagttccggtcaggccgtaaggtgcagcggtgctcgaaatgctgatctccttcctccggaaaatcctcggcggcccgaccgaggcgcccacgcggtcgggcgtgtccaagaagcccgcggccccccggcccccggccccgcaacctcgccccccgcgtcatctccccacccgggaccgcggccgcaccatcgactacgcccccgacctcgacggcgacgccgaccccggcgagatcgtctggacctgggtcccctacgaggacgacccgtcccagggtaaggaccgtccggtcctggtcgtcggccgcgacggccgcaccctgctcggcctgatgctctccagccagagcgaacgcgacggccagcgcaactggctggcgctcggcgccggcgactgggaccgcacccagcgtcccagctggatccgcctggaccgggtcctggaggtggacgaggacggcatccgccgggagggcgcgatcctcgaccgggaccgcttcaaccgggtggcggccacgctgcggagcgaatacggctgggcataatcggacaaccggatagcgttgcggcatggatacggacgtcatgaccggtttcggcggcaaacaggcgtggctggcggtgcgcgactccgagcccgaagccgtactggccgccctcgggctgcgcgatctcggcccgatccgctggcgtgacggcctcgatctggcccatctgaccggcgaccgggtggcggcgaccccgccgctgcccggcgcccgggacagccggtggaccctggtcgccggccaccatctgatgacctccgccccggacgtggtggcgatctccgccactctcggcaccgaggtgcagtacttcgccacccaccgggtaaccgagtcgcatcgatggcagcgggccgggaagggtgatctcctgcgtgcgttcggctacgtcgggcagaccggcgaggtcacctcgtggttcggcgagccgggcccggccgagcgggaggccggtctgcccggcgagttcgtcccggaggagaccaccgtgctggtcgccgagcgcgacgtgttccgggtggccggagcctggagcatcgacccgaccacgctgaccggtcccgcccccggccccctgcggatcggcgcggcggcctgaacgagacggaggccgaccacatgcgcaagtacgtgatcatgggcgtgcagggcagcggcaagggcacccagggccagctgctcgcccgcgacctggacctggtccacatcagcgtgggcgacatcttccgctggcacgtgcgcaaccacaccaagatgggtgcccaggtcaagcggatcatggcggccggcgagctggtcggcgacgacctggtcgagtcggtggtccgcgaccgcctgcaccagcacgactggaactacgggttcgtcatcgacggcttcccccgcaacggcccccaggccgagttcttcatggagagctacgacctggacgcggtgatccacctggagctgcccgacgacgaggtgcgccgccgggtgctcagccgccgcctgtgcccgaactgcgggatggactacaacctgatcgccgaccgccccgagcaggagggccgctgcgacatctgcggtcacgagctggtcacccgggccgacgacacgcccgaggcgctcgaggcgcggctgcgcgactaccacgagaagacccgcccggtgctggagctcttccagcgtaaggaggtggtccacgacgtcgacggccggccgccggtcgacgaggtgcagaacgcgatccgcaagaccctcggcctgccgccgcacatcccgcaaccggaccgctgaccgcttgcggtccgtggcctccccgggccgcgactgccgacggtgtacgccgtgagccgagccgtcctcagcgccgccggccggcttcaccggccgggcggcacgctcacgcggcgacgggctccgcgcggtgtgccggggccggccaggtgcggaccacgatcaccgcggcggcggccaggatcgcggccaggatccggtagccgacggtcaggccgctcaccaggtcggccggggaccgcagcgcgtggtgctcggcgaggaccgtgccgatcagcgccaccccgagcgccgcgccgacctcccgggccgccgagttcagcccggagccgagcccggcgttcgccgccggcagcccggccaggatcccgccggtcagcgccggcgcgcacagtcccatgccggccgccatcagcaacagatatccggcgtagaccgggtacgccgtcgccgcgtccacggtggagagcagcaggagcccggccacgatcgcaccgagcccgatcgcgatcatcggccgcggcccgtagcgctgggtgagcgggaccgcccgccgggacacgacgcccatgccgatcgccagcggcccgatcgccagcccggtcagcagcggcgagtaccccttcacgtcctgcaggaactgcgcgttgacgtagaagaggccgaacagcgcgaagaaggtcgcgccgaccccgaacgcgccggcccggaccgtgcggacccggaagacccgcgggtcgatcagcggccgcgcggcccgcagcgcgtacccggtgaacgcggccagcgtcagcgccccggcggcgaacgaggacagcaccacggtgtcggcccagccccgctccggcccctcgacgatgccgtacagccaggcgaagagaccgccggtgagcagcgccgtgcccagcgggtcgatcgacgcgtcgtgccgcggcgcccgcgggacgcacaccgcgacgccggccgtcagcagcgcggccaccgggacgaagaccaggaacaggaccggccagccggaatactgcaggaccacgccggcgatcaggttgccggccatcccgcccagtcccatgcaggcggtccacagggcgatcgcgtgcggccggcgttccggccgggtggcgtgcagcagcagggccagggtggccggctgggccagcgccgcggcgaccccgccgagcgcccggccggcctgcagcaccgcgacgtcctgcgccgacgcgctgatcaggttggcgacgccgaacaggaccagcccggcgagcagcacgcccttgcgacccagccggtcgccgagcgcgccggccgggatcagcaggccggcgaaggccagcacatacgcgtcgacgatccagaccagatcgcccgggcccgggtgcaggctgctcgcggcgagccgcgggatggccaggttgatgcccgcgaccagggcctgcagggccagcacggtcgcgcacatgaggaccagggtgaatctctcacgtctcatggaaacgacgctaagatcgaccgtatctaacgtcaaatgcatgcttcacaaggaaagattgcgtcgtacgcaatgaatctggatctgaatcttctgaccgccctggacgccctgctggaggagggcagcgtcggtggcgcggcccggcgcctgcacctgtccgagcccgccaccagccgtgccctgggccggatccgcgccgcgatcggcgacccgatcctggtccgctccggccgccggatggtcctcaccccacgcgccgtcgaactgcgcaccgaggtgcgcgccctggtcgagcgcgcccaggcggtcttcactccgcccggcccgcccgatccggccaccctgcagcgggtcttcaccgtgctcgccgacgacgtggccaccgccctcggccccgaactgctggcccgggttcagagcctggctgctggcgtcaccctgcggttcctcggcgaggacccggcgtcggacggcaccgtgcagctccgcgacggccgggccgacctggacatcggcgtggtcgacgacgccccaccggagatcaccgtcgaaccgctgttcaccgaccggatgaccgcggtcgtccgggccggccacccgctgctgcgcggcccgctgaccccgcgccgctacgccgaggcggtccacgtcagcgcctcccgtcgcggcagactcaccggcccgatcgacgaagccctggccgaacacggcctgacccgccgggtggcgctggccgtccccaccttcggcgccgccctgatcgtcgtcgcccgcaccgacctggtcggcctgatgcccgcccgcctcggccgccccgccatcgacgcgctcggcctgatcgccgtcgaccccccgatcccgctcccgcccaaggagatcgccatggcctggcaccagcgctacaccgccgacggcacccacgcctggctccgggcccgcgtccgcgaaaccatcgccagcctcgccgccacctgagccgacgccccggacccggccgcggccccgccaccccacaccgcaccctgactccgcgcgccaccagcgccgccggtcactagctagctagtcgctggccgcgctgcgctgcgccgcgccggctccggtcggtctgtccgcgtgcggcgagggtggcggtcgaaaaccacacaagcgggcatcgatggttcttctgaggcttacgccgggaccgtgtggtgtgccaattatgcggagaatgcggagcagaactttgccggcaaggagaccgaaatctctttgacatcttgtgctcaggcataagcgggcgtaaacaaagacaaagccaaatcgacagggcggtgcacggatgtacgcggaggaacgccagcaggagatcgtgcggcgcgcccgggccgaggggcgggtcgacgtggtgacgctggcggacagcttcgcggtcaccgcggagaccatccggcgggacctgaccgtgctggagcgggccggggtgctgcgccgggtgcacggcggggcgatcccggtggagcggctcggcttcgagcccgcgctggccacccgggacgccgtgctgatcagtgagaaggagcggatcgccaaggccgcgctggccgaggtgccgcaggacggtgccatcatcctggacgccgggacgaccaccgcccggctggcccagctgctgcccgccgaccgggagctgaccgtggtggtcaactcgccggtgctggccgccatgctcggtgtcaagccgaacctgtcggtgctgctgctcggcggccgggtgcgcggcaagacactggccaccgtggacgactgggcgctgcggccgctgtccgagatgtatgtcgacgtcgccttcatgggcaccaacggctgcaccgtcgaacgcggcatgaccacccccgacccggccgaggcggcggtcaagcgggcgatgatcgccgcggcgcgccgggtggtgctgctcgccgaccacaccaagatcggcaacgactatctggcccgtttcggcggcctcgccgacctggacctgctgatcaccgacagtggcctggaccacgagctggccgccgaggtcgaggcggccggtgtgcggatggtgcgggcatgatcctcaccgtcaccctgaatccgagcgtcgaccgggcgctggaggtcgatgccctgctccgcggtgaggtgttgcgggcggtggattcgcacatcgacccgggcggcaagggggtcaacgtgtcacgcgcgctgctggccaacggcgtccggtcgaccgcggtggtgccgaccgggggcgcggagggggagcaactggtcgaccttctgcgaggcgagggggtggacctggtggccgtcccgatcgtcgggcggacccgttccaacatcacgctggccgagccggacggcacggtcaccaaggtgaacgaggccggcccgaccctgtcggcggccgagttcgggcaggtcagcgatgcggtgctgaccgccgcccggtcggccggctgggtggtgatctgcggcagcctgccgcccgggccgtcggtggccgacttccaggcgctctgcgagcggctggtggcggccggggtgcggctggccgtcgattccagcggcccggggctgcgggccggggtgaccgccggcgcggccctggtgaaaccgaaccgggaggagctggccgaggcggccggcaccgaactggcgacgttcggtgacgtgctggaggcctgcgagcggctgcgcaaggcgggcgccggcgcggtgctggccagcctcggcgcggacggtgcggtgctggtcgaggagtccggtgtgctggccggccggtccccggccggtgtgccgcgcagcacggtcggcgccggggacgccctgctggccggtttcctggcagccggcgcacggggggcggacgcgctgatcgagggcctggcctggggtgcggcggcggtcagcctgccgggcagccggatgccgggaccgcgcgacctggaccgttccaccatccacatcgaccacgatccggacccggcccggcccctcggccgggactgagcggcacgacgcggctccggccggggccgcccggcgccgacaagcagcgagcggcccggtggccgcggcagaagtggcaccaggggcggcccgttgagcgcggcgggggacccatcgacgtaccgccgcaatcgcattgaccgtcatcgtcagcggccgtgaggccgtcgctcaccgctacccgaaaagaatctaaaaagtctgaaatgcgggggactggcacgagcccagtcaaggaatggagatctcatggcctctacgtacacccccgaggtcaccggcggtggtttccgtgccgcggtgcagaaactcggcggccacctggccggcatggtgatgccgaacatcggcgccctgatcgcctggggcctgatcaccgccctgttcatcccggtcggctggatcccgaacgcgaacctggcgcagctcgtcgacccgatgatcaagtatctgctgccggtcctgatcggttacaccggcggccgcctggtgcacggccagcgcggcgcggtggtcggcgcgatcgccaccttcggtgtggtggtcggcgcggacgtgccgatgttcctcggcgcgatgatcatcgccccgctcaccgcgtacgtgctccggctcttcgacggcgccatcgagggccggatcaggcccggcttcgagatgctcgtcgacaacttctcggccggcatcatcggcgcgggcttcgcgatcctcggcaagctggcgatcggcccggtcgtcgacgggctgaccaaggcggccgggaacgccgtcgactggctgctcgcgcacagcctgatgccgctcgcctcgatcctcgtcgagccggccaaggtgctgttcctgaacaacgcgatcaaccacggggtgttcggcccgctcggcgtgcagcaggtgcaggagcacggcaagtcgatcctgttcatgatcgagtcgaaccccgggccggggctcgggctgctcaccgcgtatctgttcttcggcccgaagtcgctgcggcccagcgcgccggccgcgatgatcatccacttcctcggcgggatccacgagatctacttcccgtacgtgctgatgaagccccgcctgatcctcgcgatgatcgccggtgggatgtccggggtggcgaccttcatgatcaccgggaccgggacggtggcgacgccggcgccgggcagcatcttcgcctacttcgcggtgaccgccaagagtggctatctcggaatgatcctcggcgtgacgatcgccgcggcggtgaccttcgcggtggcgtccgcgctgctcggcttcggcaggctgaagtccgaccaggagctcgacgagcaagccgaacccgcgccggcggaagtcgcccctcagcaagcctgaccagaacggagagccacccgtggccaccatcaacggcaaggacatccacaagctggtcgtcgcctgcgacgccggcatgggcagcagcgtcatgctcgccagcacgctgcgcaaacagctcggcaagaccggcgtgacggtcgagcacaccccggtcaactccatcccggccgacgccgacctggtcgtctgccacagcggcctggccgcgcgggcccggtccatcgcccccggcaaaccgatcgtgccgttccagatcttcctcggcgacccggcggtcaccaaggtggtcaaggccatccagcagggcaccgatctccatgtctgagctgctggaccgccgggcgatccggctggccgagacggcggcggaccgcgacgacgcggtccgccgcaccggccgggcgctggtcgagatcggcgccgccgacccgggctacgtcgacacgatgctggcccgggagcggtcgatctccacgtacgtcggtgccggcgtcgccatcccgcacggcaccctcgacggcaagaacctggtccaccgggacgcgctggcggtgctgcggttcccggagccggtcgactgggacggcgagccggtcaccctgtgcgtcggcatcgccgccaagggggacgggcacgtcgagctgctcgccgccctcgccgagatcctgctcgacgaggaccgggcccgcgacctgcgggacgccaccgacccggacacggtgatccggctgctcgcttcgatcaaggaggagtctgagtgaaggtcgtacgattccacgctcccggcgacgtccgtttcgaggatgtccccgagccgcaggccgggccgggcgaggtgaagatccgggtccggaactgttccacctgcggcaccgacgtgaagatcgccaagttcgggcatcaccacatccacccgccgcgggtgatgggtcatgagatcgccggagaggtggtgcagggtacgggtgactgggtgccgggcgaccgggtccaggtgatcgcggccatcccgtgcggcgagtgcccggactgccggcgcggccggatgaccatctgcccgaaccaggtgtcgatgggctaccacttcgagggcggcttcgcgcagttcatggtggtgccgcaggaggtcctcaaggtcgacggcctgaaccggatcccggacggcgtcacgttcgccgaggcgtcggtggccgagccgctcgcctgcgccctgaacgcgcagaacctggcccgggtcggcgacggtgacgacgtcgtggtgatcggttccggcccgatcggctgcctgcacgtacggctggcccgggcccacggcgccgcccgggtgttcctggtcgagctcagccgccagcggctggacatggccgcgaacctggtcaagccggacgccgcgatctgcgccgccgaggtcgacccggtcgaggcgatcctcgggctcaccggcgggcgcggcgccgacgtgatcatcacggccgcggcctccggcacggcgcaggagcagggcatccagatggccgcccggcagggccggatcagcttcttcggcgggctgcccaaggacaagccgaccatcacctgcgactcgaacctggtgcactaccgcgagctgaccatcgtgggcgccaacgggtccagcccggcgcacaaccggcaggccctggaactcctcgcctccggcgcggtcccggtcgccgacctgatcacccaccggctgccactggacggcgcgatcgacgcgttcggcatcgtcgagcgcggcgaagccatcaaggtcaccatcgagccctaggaggcgtcatgcccacacgtacggtcgcggtcggttccgccagcggactgcacgcccggcccgccaagatcttcgtggcggcggccgcggcggcgccggtcagcgtcaccatccgggtcggtgagcgcaagccggtgccggcgagaagcatgctgtcggtcctggcgctcggtgcccggcggggcaccgaggtgaccctggaagccgacggggacggcgccgagcaggccctcgacacgctcgccgcactgctggcgaaagacctggacgcggacgatgcctgaggtgacggtgctcaccgggatcggcgtctgccccggcgtcgccgccgggccgctgctgcgcatcgccacggcgccggcgcttcccgcaccggttgcggtcgccgatccccgggccgagacgattgccgcgtacgccgccatcgccgaagtcgtcgcggacctgacccggcgagcggaccgcgccaccgaggccaccgtggccgacgtgctccgcgccgaggcggccatggcggacgacgaggagttgcgcgacgccgtccgggaccggatcgagggcggggccgacgcgccgcacgcgatccacgccgcgttcgcgacgttccgcgagatgttcgccgaggcgggcggctatctcgcggaacgggtcgcggacctggaggacctgcggaaccgggcggtggcggtgctgctcgggctgccgatgccgggggtgccgcagccggggcatccgttcgtgctggcggcgcgggacctggcgccggcggacaccgcggatctcgatccgtcgcaggtgctggcgctggtgaccgaggtcggcgggccgaccagtcatacggcgatcctggcccgggcgctggggctgcccgcggtggtggcgtgccggggggtgctcgacctgcccgggaacagtgtggtggaggtggacggcgggaccgggcgcgtgacgaccggcgacttcgacgtccgattcgcgcccggaaacgcggagaaatcgatgctgagcggcccgggggccacctcggacgggcacgcggtgacactgctggcgaacgtgggatcggcgaaggacctggccgccgccggggaggcgcacgccgaggggatcgggctgttccgcaccgagctgctcttcctcgaccgcaccgcggagcccacgatggacgagcaggtgaccgcgtaccgcgacgtcttccgcgggatggccgggcggcgcgtggtgatccgcaccctggacgccggcgccgacaagccgttgccgttcctgcaccaggacggcgagccgaacccggcgctcgggatccgcggcctgcgcgtcgcccggcagcgcccacaggtgctgaccacccagctcgctgcgatcgccgcggccgccgccgacaccggggcggacgtgtgggtgatggccccgatggtgtccacggtggccgaggcgaccgggttcgcggccgccgtgcacgcggccgggctgccgaaagcgggcgtgatgatcgaggtgccggccgccgcgctgcgcgccgccgacctgctgcgggtggtcgacttcctgagtatcgggacgaacgacctgagccagtacacgttcgccgccgaccggatgtgcggcgacctggccgagctgctcgacccgtggcagccggcactgctgcagctgatcgggatgtgcggggaggccgggcgggcgaccgggaaaccggtcggcgtgtgcggcgaggcggcggccgatccgcggctcgcgccggtgctggtgggcctgggcatgaccagcctgtcgatgtcgccgcgggcgcttcccgcggtgcgcgcggcgctggcgaatcacacgtacgccgcatgccgtgccctggcggagaaggccgggtgagacggggacggccgggcggccgccccccggtcgtcagttgaacgggaagccgggcgggaactggaccggcaggtgggacaggtcgggggcgggcacgtcgaccatcatccggatcacgtcgagtgcgaccttcggcgtgcccggcgtgccctccacgacgagcacccgcttcttggtcttgtcgcggtagcccgcctcgatccggtacgtgtaccggccgctcgccgggtgcgccggcgcgtacctcggccgcagggcctggaactccggcgtggaggccaggtgcagcacctcggcctcctcccggttggccgcgccgaccagggtgaacacggactggccgccgtggccgccgccggtgcggacgacgacgaccgcgaccgcctgcttcgtcgtgacggcggtctgcggcgccgtcgcccgggtcgccgcgggtgcggctgtggtggtcggcgccggctcggtcgcgagggctgccccggcggtgccggccagccccagcaccacggcggcagcgctgatcagatacttgctcatgcctccagaatatcgggcataagtgggcgaatcaggataaccgccctagcttggcgagccgcttctccaccacgtgacacacccgctccaccacggcgaagcgcgcgtactgcttgtcgtcacccggaatcacgtgccagcgcgccttcggccggtcggtgcgttccagcatctcctcgatcgcctccgcgtaggcgtcccgcttctcccggttgcgccagtcctcgtcggtgagcttccaggcccgcagcgggtcaccggcccgatcctggaaccggtccagctgctctctgtccgagacgtgcatccagaacttgatcaggatcatgccctcggcggtcagcgtgcgctcgaactcgttgatctcgtcgtacgcccgctgccactgctccccggtggcgaacccctcgacccgttcgaccagcacccgcccgtaccaggaacggtccagcacggtcatcccgccggacccgggcagcacggtccagaaccgctgcaggaaatggtgccgcttctcgtcgtacgtcggcgccgcgaactgcgacacccgcacgtgccgcggatcgagcggcgccaccagccgcttgatcgccccacccttgccggacgcgtcccagccctcgaacagcacgcacagcggcggcccgatctgcttcggctccccgatctgcccacccagcagcagccgcaaccggagcagccgctgctgcgcctcggccagccgcgcctcggccttcttcttaccgatctcgatcggcggttccgcgctacccaggtgacccatccgatcagcatccccgaaacccggtgtgatccgcactcggcggtgcgggacaatccgtgacgtgactttcgtagacgatctgatgtggcgcggactgatccaggactcgaccgaccccgacgagctgcgcaaagccctcgacggcggctcgatcacgttctatgtcggcttcgaccccaccgccgcctcgctgcacgtcggtcacctcatgcaggtcctcaccgcgcgccgcctgcagcaggccgggcaccggccgctgctgctggtcggcggcgccaccgggcagatcggcgacccgcgcgagtccgccgagcgcactctcaacccgccggaggtcgtcgagagctgggtgcagcggatccgcgagcagctcgcgccgttcgtcacctacaccggcgacaacgccgccaccctggtcaacaacctggactggaccggctcggtgtcggtcgtcgacttcctgcgcgacgtcggcaaacacttcccggtcaacaagatgctggcccgcgacgtggtgcgcaaccggctggagagcgggatcagcttcaccgagttcagctaccagctgctgcagtccaacgacttctacgagctgcacgtgcggcacgactgccggctccagttcggcggctccgaccagtggggcaacatcaccgccggtgtcgacttcatccgccgtcgcggcgccggcccggtcaacgcgttcgtcaccccgctggtgctcaagtccgacggcaccaaattcggcaagaccgagggcggcgcggtgtggctcgaccccgccatgaccagcccgtacagcttctaccagttctggatcaacagcgacgaccgggacgtcagcaggtacctgcggtacttcagcttcaagtcccgcgaggagctggaggaactggagaaggcgaccgccgagcgtccccaggcgcggctggcgcagcgcgccctggccgaggaactcaccgcgctcgtgcacggcgaggaggaggcccggcaggcgatcgcggccagccaggcgctcttcgggcgaggttcgctcgacgaactgtccgccgacacgttgcgcgccgctctggccgaggccggattgctggcggtacgcggtgagctgccgccggtcggggtgctgctgaaggaggccgggctggtggcgagcgcgaacgaggcccgccggacgatcagcgagggtggcgcctacctgaacaacgagcggatcaccgacgctgaggcgacggtgccggccgccgcgctgctgcacgggaggttcctggtgctgcgacgagggaagcggaccttcgccggtgtcgaactgacggcctgacccgccactcacggagtctccgtcctctttcaggggaccggggctccgtcgggtggccgtccgggggcggctattcccgcgctgacctgaggttttgtcgcggcgaagggtgtgacggtggtcgctggaccccgatttggcgttgcccgggggaagcgggtaatgttttcggagccgccagggagacgggcgagcgacacgggacccgcgaggggcccggagcggccgtcctgacggaaatcttacccagatctcgcgatctcgcatcgcgggttcctcggtgcgttgaaatccggttgcgaaacacggatttgacgaaacgagaatggtgagctagctagctaggtgaccgtggcggttaccagggcggtggcgaccgcggcggtttccgtggtggcgaccgtgccgtaggcggcggtgaccgcggcggcttccgtggcggcgacggtgagcgccgtccgttccgcgacgatcgggggggcgaccgcccctcgggtggtttccgtggcggcgatcgtccgtccggtggtggttaccagggtggcggtgaccgcggcggtttccgcggtggtgaccgtccgtccggtggtggctaccagagtggtggcgaccggggcggtttccgtggcggcgaccgcccctcgggtggcggtttccgcggtggcgaccgtccgtcgggtggtggctatcagggtggcggcgaccgcggcggcttccgtggcggcgatcgtccgtcgggtggtggctaccagggtggcggcgaccggggtggtttccgcggcggcgatcgtccgtccggtggcggttaccagggtggtggcgaccggggtggtttccgtggcggcgatcgtccgtcgggtggtggctaccagggtggtggcgatcggggcggtttccgtggcggcgaccgtgaccggagcggcccccgtgagggcttccagggtggcggcgaccggggcggcttccgcggtggtgaccgtccgtccggtggtggctaccagggtggtggcgaccgcggcggtttccgtggcggcgaccgtgaccgcggtggctaccagggtggtggcgatcggggcggcttccgtggcggcgaccgcccctcgggtggcggtttccgcggtggcgatcgtccgtcgggcggcggcttccgtggcggcgaccgtgaccgcggtggctaccagggtggcggcgaccgcggcggcttccgcggtggtgaccgtccgtcgggtggtggctaccagggtggcggtgaccgcggtggtttccgtggcggcgatcgtccgtcgggtggtggctaccagggtggcggtgaccggggcggtttccgtggcggcgaccgtgaccggagcggcccccgtgagggcttccagggtggtggcgaccggggtggtttccgtggcggcgatcgtccgtcgggtggtggctaccagggtggcggtgaccgaggtggtttccgtggcggcgaccgtgaccgcggtggctaccagggtggcggcgaccggggcgggttccgtggcggcgaccgtgaccgcggtggtttccagggcggtgaccgtgaccggggtggctaccagagtggtggcgaccgcggtggcttccggagcgaccgggacggcgaccgcggtgggttccgcggcgaccgggaccgtggcgctgaccggggtgaccgtggtgggttccggggcgaccgggagcgggacggcttccagggggaccggcccgagctcgaccaggacgggcagccggtcttccaggcgcccgagatcccggccgacatcgacgcgaacgacctcgaccaggaggtgcgctcggagctgaccgcgctggcccgggacgtggccgacaaggtcgcccggcacctggtggcggccggcacgatcatcgacgaggactccgaggtcgccctgcagcacgctatcgcggcgcgccggctggcgtcgcggatcgcggtggtgcgcgaggcggtcggcctggcggcgtacgcggccggcgactggaccacggcgatcgcggagctgcgcacctaccaccggatgaccgggcggcagacgcacctggccgagatcgccgactgcgagcgggcgctcggccgtccggagcgggcgatcgacctgtaccgcggcgccgacatggcgaagctggagaagtccggcgcgatcgagctgctgatcgtggcggccggcgcccggggtgacctcggccagcacgacgcggccgtggcgatgctccaggtcaaggaactgaccgcggaggagaccgcggactgggcggcccggctgcggtacgcctacgccgacgcgctgctcgccgccggccggcgtgacgaggcccgcgagtggttcgtccgggccgccgccgtcgacgaggaccagctcaccgatgcggccgagcggatcctcgaactcgacggcgtggtcatcgagggcgacgacgaggacgacgaggacctcgacgacgatgcggccgaggacggcgagggcggcgacgtcagggcccggtccggcgccgatgacgacgaggaccgggacgacgacgaggacgaggacctcgacgacgaggaccgggccgactcggacgaggacgacgacttcgacgacgaagacgacgaggacgatgacacggacgaggcggacgccgagccggtcaccgtggccgagaccgacgtcaacaccgacgccgtgaaggccgacaagcacgaggttccggcggccgtgttcgaggcgcccccggccggcaaggccgaggacgaggacgacgagaagggcggcgacgagttcgacagccgcccggacgaccggccgcgggcatgaccgaccacctcgccggcggttacgacctcgccatcttcgacctggacggcgtcgtcttcctgatcgacaagccgatcccgggcgcggccgaggcggtcgagcggctgcgcgcggacgggacgtcgatcgcgtacgcgacgaacaacgcgtcccgccgggccgccgatgtggcctcgctgctcaccggcatgggtgtcagcgccgcaccggccgaggtgctcacctcggccggcgcggccgccgcgctcatcgccgagcacgtgcccgccggttcgccggtgctggtggtgggtgccgaggcgctgcgtggcgaggtgcgggacgccggcctgaccccggtcgagtcggcggacgagtcgccggtcgccgtggtgcagggctacggccccgaggtgggttggcggatcctgtccgaggcggcactcgccgtccgggccggggccacctggtacgccaccaacaccgaccggaccctgcccagcccgcgcggcccgctgcccggcaacggctcgctggtcgcggtgctgcgcacggccctggaccgggaaccggacgtggtggtcggcaagcccgagcccgccctgttcaccaccgcggcctcgctcgcgaaggcggagcggccgctgaccatcggcgaccgtctggacaccgacatccagggggcggtcaccgccggcatggacagcctgctcgtcctgaccggggtcagcgggccgagggaactgctggaggcaccggccgaacggcgcccgaagttcgtcgccgccgacctgtccgggctgttccgcccggccggtcaggctgcggtgccggccgccgaggtggacggctggtcgctggaccgggacggtgaccgggtcaccctgaccggctccggcgacccggtcgacgcactgcgcctgctgtgcggggccacctgggacggcgtcccggccggtaccgtcagcgccggctcggccgcggccaccgaactgctgaaatcctggggcctctgatcctgggcatcagccgctgaatgagcgcgatcatgagcagccccggccgtcatcggccggggctgcggcgtttcggcgcgtgatggtccggtccgtcgcggtctcgcgcgggccgcggcggggcggcgatgcggggggggtgtggtcacccgcgtacccccgcaatcgggtctcagaagggttgcaccgggtcggtgtggtactgcgccgggcgcggtcggtgatgacgccggggcagcggcggggcatccggatcgatgtggaagatgccgtcgaccatggcgaccatcggcgagctcatgtagtcgaaatcgggcaccgcgacccgctcggctctctcatgcacattctcaccggtgcaggtgccgtcgatctggggaacgtcggggcggacgtgattcatgggttgcctcccagtgacccggggcggccgtcgtccggcggtcgcaagctcctcaacctcatcgtgccaccgcggaacccggccggcgaggaaaatcgctctgccgcgatcagggtcaagcggagggggaatccgccgatcggggaggtgtgacttcgcttacgttgccacgcggcgcgcggctgtccgatgcctcctggcgtgcccggcaccggatcatcagccggctgctctggtgccacgtcccggtcttcctggtggtcggcatgctcggcccgcgcccccgctgggaggtgttgatgctggtcgcgggcgtcgccggctgggccgcgctgatcccggtcatgcccaaccagcaggcgcaggcgtcacacaccggcgtcgggttgatcgcctgcacgttcgtggcgatcgagctgtccggcggatcgatgaccgcccacatccacctgtacgcgatcctgatcttcgtggcgctctaccagatgtgggcgccgctgatctgcgccgtgctggtcgtggtggtgcaccacggcgtactcgggctgatcgcgccggaacgcgtgttcggcatgcaccacatgggtgtcgggtccgcgatcgaacaggtcgccgtgcacgccggcctggccgccgtcgaggtcgccggaatcgtcgtcttctggcacttcgccgaacaggccgagcgggagaacgagcagctggcggccgaagccgcggcggcccgggaggagaccgaacgggccgagcgggaagccgaccaccgggctgccgaagatctgcggctgcgctccgcggaggccgccgcccaggcccgccggatcagcgaggacgtggcgtcgatcagcgcgcaggcgcacgcggcgatctccgcggtcaccgcggtcgaccgggagctggccgcgctgaccgcgtcggtgcgcgacatcgcgtcccggtcggcgaccgcggccggcaccgccgccgacggcaaggaggcggccgcgtcggccggcgagaaggtgcgcgcactggaacgctcggtcggcgagatcgccgacgtgaacgcgatcatcgcgtcgctggccgaccagacgaacctgctcgcgctcaacgccaccatcgaggcggcccgggccggggagatcggcaagggcttcgcggtcgtcgccggcgaggtgaaagacctggcccgggagaccgcgacctcggtggaacgggtcaacacggtgatcaccgcgatcgtggcggagaccgacgacgtcgcgcagaccttcaccaggacgaccgaggcggtggacgggatccacgagctgcagctctccatcgcgtcgtcggtggaggagcaggcgaccgtgctggccgaggtgaccaagcaactgtcgacggcgaccgcgtcggccgatcaggtgctgaccgggctgcaggagctcgccgccaccgcgcggtagcgggtcgccggccgtcccccggcgatcacgttcttccgcggatgggcttgaacgattccgcggccgccgtccgtactcgctggcgtgatcgtcgggctagagcagcttgcggagcttgagcaggtcgaacgggttcgccttgatcgagatctggcgagtggcgatcgcacgggtgatgtccagccggccggcgatcagggccagcaggtcgtcgctggtcgtgctgagggcgatcttcgcctgggggtcgtcgccgtcggcgatgccggtcagcaggccgccggtgatccgggcgtggaaggccgtggccaggtcggtgacccggcaggccagggagcggtcgaagtcgaggcggccgcgggcctccgcgttcgcctccaggcgcgtggccaggtcgtgcaatgcctgccggcactcgtccacggtggccatcggcatcccccctcgcgacaccagcaccgtacctcaggaagttgtcgggggctcccggtagcgtggcacccgacgtggcgagaggaggaccgatcatgccagacgcatggcgggcttatctggacctggcgctcgggcttaccgaggcgccccggaaaaaggcgcagcaagtcgccggtgagctgctcagccggggtggtgcgacggcggcgcaggtgcagggcctggtcgaggacctgctctcggccggcatcgccaaccgggaggcgctgaccaacatcgtccgcttcgaggtggatcgcgcgctcgggcgggtcgggctggccaccgcggacgaggtgtccgagctgaccgggcgggtgcgggacctggagaagcggctgcgggaggcactagctagctagcggcgaagggtgcgccggtcaggaagacggcggccggcaaggccgcggcgaagggtgcgccggccggtggcgcgccggtgaaacgggcggcgcgcaaggcggcgcaggtgccggcgcagtcgcaggccaggaagtcgcagccggtggcggagagctccggccggaccgagagcacggaggcgtgatcccgtgacgttcccgcaaggtgcgcagggcgggccgcggcccggtggtttccggccgggtccgccatccggtgaattccggcccggtccgccacccggtgggttccgtccggggccgccgccgggcggcccacggccgccggcggatggcggcgagccggtggcggcggcgcattaccgcaccggcgacgatggactggtggcggagaccggtcacgcggcggtggacgcggtgctaagttcgctcgccaacgccgcgcggctggccccggccgagcagatcgccgagtacgaggccgcgcaccaggtgctccaggacaccctggccggcatcgaccgctgaccgacgtaccgacaaaggatcccgatggcccgccgtgcgcgtctcgacgccgagctcgtccgccgtaagctcgcccgttcccgggaacaggccgcccaactcgtggcggccggccgggtccaggtccgggggaccgtggcccacaaggtggcggccatggtcgacccggccgatccggtgctggtcaccggcgaggacccgcagaccgagtacgtgtcccggggcgggcacaagctggccggggcgctcgccgcgttcggcccgaaagggctgaccgtccaggggcggcggtgcctggacgcgggcgcgtccaccggcgggttcaccgacgtgctgctgcgcgccggggccggccgggtggtcgccgtcgacgtcgggtacgggcagctggcctggccgatccggaccgacgggcgggtcgacgtgcacgagcggaccaacgtgcgcacgctcaccgccgaggccatcggcgggccggccgacctggtggtggccgacctgtcgttcatctcgctgcggctggtgctgcccgcgctggccgcctgcaccgcgccggacggcgacctggcgctgatggtcaaaccacagttcgaggtcggcaaggagcgggtcggcaccggtggtgtggtgcgcgactggcggctgcgggccgaggcggtgctggacgtcgcggcggccgcggccgagtcgggcctcggtgtggtcgacgtgaccgccagcccgttgcccgggccgagtggcaatgtggagttcttcgtctggttccggcgcggcgccccggccgcggaccgggagcgggtggaagcggtggtcgcggccggcccgtccggcgtggtgctgcccgaggagtccgtggcgtcggccggttcgtccggcgcggtgctgcccgaggagtccgcgtccgtggtggcgcgggagaatcagccggttgccccactggaggacagatgactcggtcggctttgctggtcacgcacaccggacgccggcagagtacgcagcatgcccgcaccgtggcgctcgatctgatcgccgcggggttcgaggtgcgggtgatcgccgacgaggtggccgatctgggcctgcccgacgaggtgatggcggtcgaggggccggccgcggccgacgacgtcgagatcgtgctggcgctcggcggggacggcaccttcctgcgggccgccgagctggcccggccggtcaaggccccgctgctcgggatcaacctgggcaaggtgggcttcctggcggaggccgagatcgagcacatcgaccaggcggtggccgagatcgtggccggcgactacgcggtcgacgaacggctgaccctggacgtgcgcgcggagtacgacggccgcctgatcgccgagtcctgggcgctcaacgaggtgaccgtggagaagggccagcgggcccagatgctcgaactgatggtcgacgtggacgggcggccgctgtcccgctacggctgcgacggtgtggtgtgcgccacaccgaccgggtcgacggcgtacgcgttctcggccggcggcccggtggtctggcccgaggtggaggccctgctgctggtgccgatcagcgcgcacgcgctgttcagcaagccactggtgaccgcgcccacctcgaccttcgtgctgaccgtcgacccgtacacgtcgttcgcggtgctctgctgtgacggacgccgcacctgggacctgccgcccggctcccgggtgaccgtcgagcgggggcagctgccggtccggctggtccggctggccccccggccgttcaccgacaccctggtggcgaaattcgagctcccggtggtcggctggcgcggcaaccggcgctgacccgggtgggacggatgggcgggccggccctcccgcgtacccccgattgacgctgatcagaaacacccgcgctgggcatttgtcggggggtcccactaccctctgccgtgtgctggaggaactgcgcatcaccggactgggcgtcatcgacgacacgaccctgcggctgtcggcggggatgaacgtgatcaccggtgagaccggcgccggcaagacgatggtcgtgaccggtctcggactgctgttcggcggccgtgccgacgccgggcgggtccgcgccgacccgggccgggccacggtcgagggacggctgcggctgcagggcaccctgggcgacgcggtccgtacccggatcaccgacgccggcggggagaccgacgaggacggttcgctgctgctgagccgtacggtcaccgccgagggccggtcccgggcgcacgtcggcggccgcagcatgccggtcgccaccctgagcgagctgggcgagcaggtgctggccgtgcacgggcagtccgaccagctgcgcctgttgcgcccgagcgagcagcggtccgcgctggaccggttcgccggccccggccacgaaaaactgctggacggctatcgggaggcgttcgcccgctggcgcaaggtggtcgacgacctggccgaccgccggcgcaacgcgcgccagcgctcgcaggaggccgacctgctcaagctgggtctcgacgagatcacccgggtcgacccgcagcccaacgaggacgaggacctgcgcgccgaggtgcagcgcctggagcacgcggaggggctgcgggtggctgccgccctggccgcgcaggcgctggccggcggggtcgaggcggccgacgacaccgccgacgcgaccaccctgctcggcaccgcccggcgcaccctggagggccagtccggcgtcgacgccaagctgggcgacctggcgctgcgcatcgaggaggcggccaccctggtgggtgacgtcgcctcggagctctccgcctacctcggcgagctggacgccgacccggcccggctggaggcgatctacgagcggcgggccgcgctgcgcgggctgacccgcaagtacgccgacgacatcgacggcgtgatcgcctgggcggagaacgcgaaatcccgcctcggtgagctggacagctccgacgagctgctcgacgagctggacaaggagcggcagcggctggccgccacggtcggtgagctggccggccggttgaccgcggcccggcgcgaggcggcgacccgcttctccgaggcggtcagcgtcgagctggccggcctggcgatgccgcacgcccgggtcgaggtggcggtgctgacccatgccccgtcccgggacgagccggcggtcaccgtcgacggccaggagctgggcgccgggccggacggcgcggacgaggtggagctgcgcctgctggcccacccgggcgccccgtcgctgcccctgcagaagggtgcctccggtggtgagctgtcccgggtgatgctggccatcgaggtggtcttcgccggggccggtggcccgccgacgctggtcttcgacgaggtcgactcgggggtcggcgggaccgcggcggtggagatcgggcgacggctggcccggctcgcgcgcacccatcaggtgttggtcgtcacacacctgccgcaggtggccgctttcgccgaccggcacctcgtggtggcgaaagacaccggtggcgcgatcaccacgagcggggtgcgcatcgtcgaggagaccgagcgcgcccgggagctctcccggatgctggccggcctgcccgattccgatctgggtatcgcccatgcggaggagttgctggcggtcgccggtcgagagaagcgcggatgaaaagtcccttttgtcgatgagctagcgcatgtctaacgggggccgcgtgaagcggcatgtcaggatggccgggatgcgacttcccaccttgcgccgtgtgcgcaccagcgagccgggcccggtctccggcgtggcccggctcgaccggcgcaccaagcggctgaccggccggctgcgtcccggcgagatcgccgtgatcgaccacgtcgacctcgaccgggtcgcggccgactcgctggtcgcctccggggtgaccgcggtgctcaacgccaagccgtcgatctccgggcggtatccgaacctcgggcccgaggtgctcatccagggcggcgtggtgctggtcgacaacctgggcgaggaggtcttcgccgggctgcgcgagggccaggtggtcagcgtcgagggcgaccaggtgctgctcgacggcaagccggtggccagcggcacccggcaggacgcggagacggtcgccaagagcatggccgacgcccgcgagggcctgtcggtgcagctcgaggcgttcgccgcgaacaccatggattacctcaagcaggagcgtgacctgctgctcgacggcgtcggcgtgcccgacgtgcagacccggatcgccggccggcacgtgctgatcgtcgtccgcggttacgactacaaggaggacctcgacgtcctccgcccctacatccgggagtacaagccggtcctgatcggcgtcgacggcggtgccgacgccctggtggagaacggctacacccccgacatgatcatcggggacatggactcggtcaccgacgacgtgctgcgctgcggcgccgaggtggtcgtgcacgcctacccggacgggcgcgcccccggcctggaacgcgtccgcaacctcgacgtcgacgcgctcaccttcccggccgcggccaccagcgaagacctcgccatgctgctcgccgacgagaagggcgcctcgctgatcgtggccgtcggcacgcatgccaacctggtcgagttcctcgacaaggggcgcggcgggatggcctcgacgttcctcacccggctcaaggtcggcggcaagctggtcgacgctaaaggcgtcagccggctctaccggcagaacatctccggctcggcgctgctgctgctggtcctgtcggcgctggcggcgatggccgctgcggtggcggtctccacggtcggcaaggcgtatctgaccgtggtgtccgagtggtgggacaatctcgtcttccagctcggcaatcttctctgagggcgtcgtgatcaacttcaggtaccacgtggtgtcgctcaccgcggtcttcctcgcgctggcgatcggcctggtggtcggcaccgccgcgctcaacggcccggtctcggagaaccttcgcgagcagctcaccacgctcaacaaggacaacaacgtcaagcgggaccaggtcaaccagtacaaggaggagctgaaccgcagccaggacttcgccgcccaggtcgcgccgtggctcaccacgaagctgaccgggcgcaaactggccgtggtggtgctgcccggcggcagggactcggccgacggcgtcgtcaagatgctgaccacggccggcgcgacgatcaccgcgcggatcaccgtcgaggacaagttcctcgacccggggtacgcgacccagctgctcgacctggccgatcagtcgtcgcagccgaccatcccgtcggccggcctgccgtccaacagcgacggggtggagaccgccagcgcgctgctcgccctcaccctggaccagggcgccaccgtggtgaacccggacgacgtcaccgcggtgctgaccgcgctcgccaagcccggctacatctcggtggccgagaaggcgagcggtggcgccgaggggatcgtgctggtcgccggtgccccggccaccgacaaggacgccggaaagaagaccgccaacgcggtcaccgtggccaaccagttccaccgctaccgtccgctggtcgtggccggggacggcgccggcgacaacaacctggtgtccgcgatccgcagcgacccgacactggtcaagcagatctccacggtggacaacgcgagctccgtgcaggggcaggtcgccaccgcgatggccacccacgagcggctggtgcagaacaaggtcggccagtacggcctgggcaccggcgccacctccctggtcccctccgccgcgccgtaggccgtggccgcaatccggccgtggccgcaatccggccgtcgccgcaatccggccgtggccgcaatccggccgtcgccgcggccgccggcccggcgatcggggcgcgaggacagcccggccgcggtggtgcgcgtgtgtggctgcgctggtgcgcatgcccgcgggctgcgtggtgcgcctgtgtgttggctgcggtggtgcgcgtgcctgcgggctgcggtggtgcgcgtggtgcgggctgcggcaccgacccggtcgggtttcggttgccgggctagggcagactttcgccatgggttttctgcgttcgctcgggaccggcgcctcggtggcgcgtgccgtgctcggctgggtgcgccgcgatccgcaggctagctagctagggtgcgccgcgatccgcaggcggccggcctgcgccggaccaacttccacgggcgcacggtcaccctggccggcgggccggccctggccgccggagcgaccatcggcgcggccagcggagcggccaccggccggctcaccgcggcggtggtcgccgcgggcgcggtcagcggcgcggtcggcctctatgacgacatcgtcggcaaccggcccgagcagacgaccgcgaaaggcttcgccggccacctgggcgcgctgcgcgagggccgggtcaccagcggcctcgtcaagatcggcggggtgggcgcggccgggctggtcgcctccgcgctgatcggcagtcgccgcgacggtgcgttcggccgcggcgtcgacgtgctgctcggcgccggcgtgatcgccggcacggcgaacctgctgaatctgctcgacctgcgccccggccgggcgatcaaggccgggatgatcctcggcgccccgctcgcggtgggccggcacgcggcgatcaccgccggcacgctcggcgcgagcgccgccctgctccccgccgacctgaacgaggagatcatgctcggcgactcgggggccaacgccctcggcgccctgctcggcgtcgcgtacaccgcccgcaccggcaccttcggccgcctggccgccctggccgcgctcgcctcgctcaccgcggccagcgagagggtcagcttcaccaaggtcatccaggacacgccgtggctgcgcagcctcgacgacctcggccgccgaccggcgtgacctccccgaacaacgccgacgccactcccgcgccgccggctgcttcggcaagcccggccgctccggcgccgccggtccccgccgccggcgcgtccacggtcccggccgggtcggcgagtgccgttgcgggcagcgggacggggacggcggcgaagatcgccggcgcggcggcgctgatcaccctgctcaccatcctggcgcggatcgtcgggttcggccggaccgtggtcttctactacaccgtcggtgagggcgggcacggtggcctgccggatctttacttcgccgcgaacaccgtgccgaacatcgtcttcgaactggtcgccggcggggcgctggccagcctggtggttccgctgctggccggggcggtcgccgacggggaccgcgcccgggtcggccggatcacctcggcgctgctcacctggatggtggcgctgaccgtgccgctcgcgctgggggtggcgctggcggccggcccgatcgccggcctgctgcacggtgtgccgccggagcatcaggccatcgccgcccggatgttgcggatcttcgcgccgcagctgccgctctacggcatcggcatcgtgctgaccggtgtcctgcaggcgcaccatcggttcgcgtggccggtgatcgcgccgctgctgtccagcgtgacggtgctgaccgcctatctggcgtatgccggggtcgacggcgcccggaccgatgtcgacgggctgtccaccgcgggcgagctcatcctgtcggtgggcaccaccctcggcgtcgtggtgctcagcctgtgcctgctgatcccgctggtcaggttgcgcctgccgatccggccgggcttccgcttcccgggtggcgagggccgccaggcggtgcggctcggctgggccggtgcggtcacagtcggcgcgcagcaggtggtggtcgcgttgatcgtcacgctgggggcgcagcagctggcccggtacaacggcgcccagacggtgttcctgctgccctgggcggtgctcgccgtgccgctggcgaccgcggtctacccccggctcgccgatgccgtggtgcggcgcgacgaggacgcctacgcggtctccctggccggcaccgcgcgttcggtggtgctgctggccgggttggggacggcggcgctggccggtctggccgtcccggcgtcgcacctgatgaacgccgagggcgccgccccgggaatcgtcggcttcgcgcccgggctgttcggctacgcgctgttcgccctgctgtcccgtgcgctctacgcccggggcgcgacggtcgcggcagcgaccgcggccgggatcggatggctctgcgccggtgtcgccgtcgtggtggccaccgccggtttcgccggcggcgcggagctggccgggctggggctggccaacgcgctgggcatgaccgtgaccggggtgctgctggtactggcggtgcgccggcatgccgggccggcggcgctcgccgggctgggccgggccgccgtggccgcggtggtcgcggccggtctggcagcgctcgccgggtggggtgtggtggccgggctccggtcggctttctggccgacggccgggattttcggcagcctggcggagggggtgtcgggcggcgcggtggtggcggcggtgttcgtggcggtcgcgttcgcgctggaccggcgtgacctggggcccctcgccgggaccgtgtccccgcgatggcgaaggtagggtcggcggccggaacggacacgggacggttaccgaggtaaccgcgtcgcggcccggatggcagcggtccccgccgatccggtaaaccgttggccgaggcaggacgatcggtggcggccggcaggacgggacgcgcgcggatgaggcgcgaggagaggggtagaccgctcgtgagcagcgacgacgggtggcacggttcggtcgtgctggtgctcggctcggcgaccggcggcaccggcggacacgtcctctcgctggcccgcggcctggtcgcggccggctgccgggtgctggtctgcggtccggccgccaacgacgagcactacgggttcggcgcggccggggtggagtacgcgccggtggagatcccggcggatccggggccgcaggattccggggcgatccgggcgttgcgcaaggcgatcgccgggcgggacgccgacgtgatccacgcgcacgggttgcgggccgcgttcgtggtgtcgctggcccgcaccggggtgccgctggtggtcacctggcacaacgcggtgctcgccaaggggctgcgcgggcaggccggcgccctggtggagcggatcgtggcgcgcaacgcggcgctgaccctgggcgcctccgaggatctggtggagcgggcggtcgcgctgggcgcgaggaacgcccggctcggtccggtggcggcgccggcgatgcgggcgccgaaacggacccggcaggcggtccgggccgagttccagatcaaggggagcacgccgctgatcctgtcggtcggccggctgcatccgcagaagcactatgacctgctggtcgatgcggcggcccggtggcgggagctggacccggcgccggtggtggtggtggccgggtcgggtcccagctacatgcccctggcgcagcgggcgtcgcggctgcacgccccgttccagctgctcggccaccggggggacgtgccggatctgctgctcggcgccgacctggcggtggtcaccagcgactgggaggcgcggcagttgttcgcccaggaggcgttgcgggccggggtgccgctggtcacgaccgcggtgggcgggttgcccgggctggtcggggacgccgccgtgctcatcccgccgaacgatctggacgcgctggacaacgccgtacgctccgtgttgtcggacccgcagcgccgggcggacctggccgcccgcggtccgctgcaggccgcgacctggccggacgagaccgccgtggtgaccgcggtccgcgccgtgtacgccgaggtcagcgcccggtgaccggccggctggaccagatccggcgggtgcgtccgccgggcaccccgcggggccgcggcgccgccgcctgggtgccctacctgctggtgctgctgatcggcgccgcgacgctggccgggttgacgatccgcccggccggggacaccaagcggggtgccgccgactacgtggtgatcgccgccgcggccgggctccgctgggacgacctcgacccgcagcgcaccccggcgctgtggcgggaggcggccaaggggtccaccggctggctgtcggtgcgctcggcggatcaggtgacctgcccgtcggacggctggctgacgctcggctcgggcaactacgcggcctgggacacccgtccggtgcgcggccgttgcccggcgatcaccccggatctgacccggccggacacgatcggcgcgagcgtgaccgcgcagagcaccgtggtccggatgaatcaggatcggctgccgtacggcaccaccccgggcgccctggccgagtcggtgcgatgcacggtggcggtgggccgcaacgccgcggtggccgccgcccgcccgttcggccgggtcgacgagtacgtggacaccctgcccgacgatccgcgcaagctgctctccgactgtgtgctcagcatcgtcgacctcggcacgatcgccggttccggtgcggagcggcaggccgcggtcgccgccgcggacgcgaacctggcccgggtgctggcggcccgcccggagcggtcgctgatgctgatcgccggggtggccgacaccgacgccacctcccggctgcacgtggcgatcgccgagggggagggctggcagggtggccggctgacctcggccggcaccgggcgcgacggttacctgcagctgatcgacgtggcgccgacggtgctggcggtgctcggccggccggccccggacaagctgttcgccgggtacgcggcgagtgtctcgggggaccgcccggacgacccggccaaggcgatgcaggggcacaacgacgcggatcggcgggcgatcgcccagcgcggcgtcgcgtcgatcttcttcacggtgctggctgccgtacaactcatcctgttcgtcggtgtgattccggttttgatccgtgctcgccggcatgccggaccggtcgcgccgccgctgccgccgcgccgcctggtcgcggtgctggaggcggcgctgatcgcggccgcgctggcgatcccggccgggctggtcgccgacgtggcgccgtggtggagtgcggatcatccggcctggatgttcggcgccgccacgttcgcgctgatggtggccgggacgtgcgcggtgcggctggccccgcggttccggatgacgctgtggccgatgggcgcgaccggggcgctgagcgccatcgtgatcgtggtggatctgctcaccggggcgcggctgcagctcaacggggtggccgggtattcggcgacgcacggtgtccggtacgccggtctgggcagtgtcggcctgggcgtgttcgtggccggtctgctgctggccgccggctgtctggcccagtgggtcgggcgccggtggcggccgaccgtggtggtgctgttcggcggcctgggcgtggtgatggtcggcagcccctatctgggggccgatccggtcggcgcgatcgcggtcaccaccggggtgtgcgtggccgccgcgatgagttcggggggctggctgaccttcgcccggttcgcctgggcgggggtcggcgcgatcgcggtgaccgccgggttcgccgccttcgagctgcaccgggcgccgctggagcagggcaccctgggccggttcctgagcgcgctgggcagtgggacggccggtccggcgatgcagcgggctgccgcggccaacgggcaggccctgctggacagtccgctgagcctgctggcgctggccggggcactgatgctggtcttcggccagttctcgccgtggggtggcctgaacagggtgtacggactgcatccggcggtgcgggcggcgatcgccggcaccgtggtggcgtcgatcacggccggagtgttcggcggcaccgcgctcggggtggccggcgcggccgccgcgaccgcggtcccggtggccgtgctgaccgcgttgcgggtgctgctgcatgccgcggatcgcaccccgccgcccggtcagaccgacgggccgggcggcccgttgttgcgcaaagccgacgaggatcaacggacagtgaccgaaggggccggctgacacgcacgcccaccagcccgaacgtggcgggcccggcaatgagtgttacggtgaattcccgtggatggggcgaggacgccccggtctgcagatctggaacgacaggcgaccacgggagcgggccttggcctcaacagtgcgcgacacgcggcacatcttcgtcaccgggggcgtcgcctcctcgctgggcaagggcctcaccgcctccagcctcggcaatcttctcaccgcccgcggactgcgcgtcgtgatgcagaagctcgacccttacctgaacgtcgacccggggacgatgaacccgttccagcacggtgaggtcttcgtcaccgaggacggggcggagaccgacctggacgtcgggcactacgagcggttcctcgaccgtgacctgtccggcaaggccaacgtgacgaccggccaggtctactcggcggtcatcgcccgggagcggcgcggcgagtacctcggtgacaccgtgcaggtgatcccgcacatcaccaacgagatcaagagccggatcttcgcgatggccgacccggacgagaacggaaacgtcccggacgtggtgatcaccgaggtcggcggcacggtcggcgacatggagtcgctgccgttcctggaggcgatccgccaggtgcgtcacgaggtcggccgggaccacgtgttctacctgcacgtctcgctggtgccgtacctggcgccgtccggcgagctgaagaccaagccgacccagcactcggtggcggcgctgcgcaacatcggcatccagccggatgccctgatctgccgcagtgaccgggagatccccgagaagatgaagcacaagctggcgctctactgcgacgtcgacgccgaggcggtcatcgcctgtccggacgcgcccagcatctacgacatcccgaaggtgctgcacgacggcgggctggacgcctacgtcgtgcgccgcctgggtctgtccttccgcgacgtcaactggcagacgtggaacgacctgctggagcgggtgcaccacccgaagcgcacgatcacgatcgcgctggtcggcaagtacgtcgacctgcccgacgcctacctgtcggtctccgaggcgatccgcgcggccggtttcggcaacaccgtgaagatccagatccgctgggtgccgagcgacagctgcgagacgccggccggcgcggccgccgccctcaagggtgtcgacggcatcgtgatccccggcggcttcggggtgcgcggcatcgaaggcaaggtcaacacttcccggtacgcccgggagaacggcgtgccgatcctgggcctctgcctcgggctgcagtgcatgaccatcgacgcggcccgcaacctggccggtctggccggggcgaactcgctggagttcgacgagaccgccacctacccggtgatctccacgatggccgaccaggaggacatcgtcgccggcaagggtgacatgggcggcaccatgcggctgggcgcctacccggccaggctgaaggacggctcgatcgtcgccgaggtgtacggcgcgaccgagatctccgagcggcaccggcaccggtacgaggtgaacaacgactaccgggacaagctcacccaggcgggcctgatcttctccggcacctccccggacggccggctggtcgagttcatcgagctggaccgtgcgacccacccgtacttcgtggccacccaggcgcacccggagctgaagagccgcccgacccgcccgcacccgctcttcgacggtctgatcaaggccgcggtcgcgtacgcggccgccgacgagctgccggtcgaggcgagttgatgggcttcgagcacgagacggtcggcaccgtcgagcgctaccggggggcgatcttcgacgtggtcaccgacgaggtgacgatgtccgacggcggcaccgcccaccgggacgtggtccgcaacaagggcgcggtcgtggtggtcgccctcgacgaggacggccgggtggtgctgatcaagcagtaccggcacgcgatcggcgccaagatctgggagctgccggccgggctgcgcgacgtcgacggcgaggacccggcggtcaccgcggcccgtgagctggccgaggaggccgacctcacggccggccgcctcgagcacctgatcgagctgcacacctcgcccgggttcagcaccgagcacgtgctggtctacctggcccgcgacctggctccggtgccggtggcggaccggttcgcccggcacgacgaggaggccgatctggaggtcgtccgggtcgcgctggacgaggcggtcgcgatgatcttccgcggggagatcaccaacgcggccgcggtcgccggtctgctcgcggcggcccgcacccgctgactcactccgccgccgggcacgacgcgcccggcggcgggatcgtgaggtcgatcaggtagcggtcgaccatcgcggtggtgcaggcggtggcctggtacgagccgtggccggcgccctcgtaggtgaccaaccgaccgctggcgcccagttcggtggcgacgtgccgggcccagccgtacggcgtccgcgggtcgtgcacggcgttgagcagcagcagcggggtgcgggtgtgcacgtcgaggcggtgcggcgggttggcgagcggctgcggccagcccagacaggtgcggatcgccagcatcccggcgccgtacggcacgtccggtgacaccttcgcggtgatcgcgagcagccgctggtaggcacggaagtcgcggacgtccgccgggaagtccgcgcagaagatcccggaggccacgtcgagcttcggtaccggcgggggcgtgccgttcgccgcgttcctgatcgtggtggccagcagcgcccagttcggggtcaggcccatcggcagcgcggccacctcgaaggtgctcacgcccgggtagtcgtgcagcacggaccgccagacggcgcggacgtcgctgccgtgcagcgcgcacccggtgtgcccggcacaccaggccacgaactcctcgaaaacgtcctgcgaggcggcggcctcggagcggacgaactcggtgagcggcaggtaagggtcgaagacgctctccagcacgatggcacgcacccgatcggggaaccgttcggcgtacatctggcccagcaccgtgccgtaggagctgccctggaaggtcagccgccgctcgccgagcgcccgtcgcagcgcgtccaggtcgcgggcgatgctcaccgagtcggcgtgcgcgaacacctcgttgctcgcccggcaccgctgccagtaggaccggttggtggtcaccgcggcgtcgaaatccgcctggtcgcgcaggatgaggggcgggcggtccggttccggcgcgcaggtgggcgcggccgtccgcttgacggtacgggggtcgaagctgacgatgtcgaaccgatcccgctgttcggcgctgaaccggttgttgatccggacccggtccaccccggagtcgcccggcccgccggggccgaagacgagcgtgcccaccctggcgtcctggtgcggcgtggcccgcttggtcaccaccgtgccgaaggtggcgccgtgcgggtcggcccagtccaccggcagggtcagggtggcgcaggtgaggttcgcgtccggctgctcgcacgggccccagtccaggccgggcgggcggtgtaccgccaccgggccggcggccagggcgagtgcggtgaacacggcggtcaggcgcatgccgactcctcggatcgagtgatgctgaccgattcatcgaacgcccgcgccgccccgaagatccatccggcgtagcccttagggtgccccggagatccggttcagggtcgccgtgcacgccgcccgccacgcctcgtccttgaggatccggtcgtagtcggcgccgtgcgtccagaccggcagcggcggctccacctcggcgcgcagcagcgggacggcggcggccgcggccgggccgatctcgccgaggcaggcgaccacctgcagcgccgaccggcggcacctgaggtgggcggtgaggaccgggacgaccggtgcggcctcgccggtcacccgccagtaggcgaccgccgcctcaccggccgtcgcgcagtccggcgcggcgaacagctagctagctaggggtcctccgggtgggcggcgagcagccggaggtagctgggcaggccggcggcgaccgcggtgcgcgcggcggcgacccagccgtgctcggcggcgatccgctcgcgcatcgccaggccggcgcggaccgcctggtcgtgctcgtgcacgtcgtggtagccggcgccggtggcgatcacggcgagcagcccgagcaccccggccgggtcggcgccgggcgcgtccaggatccggatcaggaacggcaccgcgggcgcggtggccgggtagacggtgccctggtgccagatgttgccgtgcaggtcgtgcagcgcgtcgtcgtcaccgccggcgagcgcccggatcaggtccgggacgtcctccgccgggccgtacgcgtgggtcagcgacgcccagtccaccgttgcaagatcgtccagcacatgcaagaaggtaccgagttgcggccggcgcaggggccaaagggggtggtcacaccgtccaggccggttccagcgggacgccgtctccggacgagcacgcggcgaccgccaacggctgcccgtcgtcggcgaccgcgagcagcgcggcgagcgtgtgcccgggccggacaaaatcggcatcggccggaggatgggacggaccgtacgcgaaccgtatgatccgggcggtggcgagggtggccgggaacggcttgccgaaggcgcggaccacctggaagtggtgcacttcggcgcgccggaaggtgtcgcgctggccggcggcgatcgcgtcgtggccgtcggccatgaacgcccgcagggcggcccggtcccgccagcagccgacgatccgggcggtgcacgggtcgctccagccgcccgcctgggccaggaagccgggccggccgcgcagcgccgaccagccggcctgcgcggcggcgaagccggccacgtcggtcacttcgcagacgatcaccttgaggagcacggcgatattttgtcggacccgggtagtaggttcacgacgccctactggatggaggggatcgtgacctttccgaagctgcagtccgtggtgctggacacgccggacgcgcgggccctggccgagttctaccggcacctgctgggcctgcgatatcggcccggcgacgagcccccggcaccgggggaggacgacgagaagggccgcgactggctggtgctggagggtgacggcggcatgcggctcgccttccagcaggagcccgggctgaaaccgaccacctggccggacggcaccgtcccgcagcagatgcacctggacaccgcggtggactcggtggccgagctgaaccggcagcacgagcgggccctgagcctgggcgccacgctgcggttcgaccgcagcgacgacgaggacgagccgctgcgcgtctatgccgacccggccggtcacatgctctgcatcttcgtcgcgtcgtaagcggcgcgtgcccggtccacctcgcccaggtgaccgccggcccaggtggccagctgggcgaagaccggggcgagactgcggcccaggtcgctgatctcgtactccgcgcgcggcggcacctccgcgtggtaggtgcgggtgatcaggccgtcgcgttccagctgccgcagccgctgggtgagcaccttcggcgtgatcgtcgggaggcggcgctccagctcgacgaaacgcagccggccgctctcgtgcagcgtccagaggatcggtgtggtccatcggctgaagacgatgtcgaccaccggggcgatcgggcaggcctgcagggggtcggtgctggtaacgctcgtcacaaaatcattactatcctctaggtacctaccgtgtccaggcatttagcgtctttctcacaggtccacgagggaccggagagggagtcgcaatgatcgtggtgacgggggcgaccggcaatgtgggccggccgctggtggcgacgctgaccgagggcggcgcacgggtgcgggcggtgtcccgcgcggcgccgcggtggccggccgacctggccgacccgccgagcctacggccggcgctggccggggcggaggcgttcttcctgctggtctcgggcgccggtgcgcacctggatgggccgaccatcctggacgaggtgaaagccgccggggtgcggcgggtcgtgctgctgtcctcgcagggcgccgcggcccggccggcgcacgccccgctgcgggcgttggaggagaccgtgcgggggtccgggctggagtggacggtgctgcggccgggcggcttcgcctcgaacgcgctggcctgggccgagtcgatccgcgcccggcgggaggcgcgagccccgttcggtgacgtcgggctgccgctggtcgacccgcgggacatcgccggggtggcggccgcggcgctgaccgatccggcgcacgcggggcgggtctacgagctgaccgggccggagctgagcacaccgcggcagcgggcggcccggatcggtcaggcgctcggcgaggcggtgcgcttcgtcgagcagaccgtggacgaggcccgtgcgcagatgctgggattcatgccggcgccggtcgtcgatggcacactcgccatcctcggcgcgccgaccgccgctgagcagcggatcaccccggatgtcgagcgggtgctggggcgtccggcgggcactttcggagggtgggccgaccggaaccggcacgcattccagtgatcatccggtgtcgcacggtaacttgtccgctgtggacatgctgtcgatgatcgccgatgagcgccgccggatcgcggagctgatcgagtcgctgaagccgagtcagctgatcacgcccagcctctgtgccggctggacggtgcacgaggtggcggcgcacctctgcgcgccgtggatcttcggggcccggcggatcgtgccggcggtgatccggcacggcttccgggtgcaccgggccaatgccgacctggtccgcgacctggcgctggacctgaccgccgacgagatcgcgctgcagctgcgggcgaacgccgagttcgacttcaacccgccggtggtcgggccgttcgggcagctcaccgatctgcaggtgcacgggcaggacatctgccgcccgctcgggttgacccgggacctggtgcccgaacggatgctgctcgcgctggacttcctgatcagcccgaaggcgcgcggctcgttcgtggcgcgtggccgcttggacgggctgcggttcatcgccaccgacctggactgggagggtggtcagggcctgctgaccgtgcggggcgcgggggaggcgctgatgctggcgatgacggggcgcccggtggtgctcgacgagctgcacggcagcggggcggcggcgctgcgggcacgactgctcggttgaatgttgcgtactcgttgaacgagggacagaatgggagcgctcccaatccgtccccgtcgattggtatcccccatgagactccgcacgatggcgttgttcgcggccggtgcgctggccaccgcgggcaccctggtcacagcgctgcccccggcgtccgcggccagtgccggctgctccgtcacctacaagatcgccagccagtggcccggcggcttccagggcgacgtcagcgtcaagaacctcggcgacccgctcacctcctggagcctcggcttcgacttcccggacagcgggcaaagggtgacccagggctggagcgcgacctggagccagagcggcgcgcacgtcaccgccgcctcgatgggctggaacggctcactggccaccggcgcgaccgtgggtgtgggcttcaccggcaccttcagcggcgccaacccggtgccggccgccttcaccctgaacggagtggcgtgcaacgggacggttcccgcgtcgccgtccaccccgcctccgccgtccggcgccgcccccgctctgaaagtcagtggcaacaagctggtcaccgccgccggagagacgcggcggctgctcggggtcaaccgctccggtggcgagttcgcctgcattcagggcaacggcatctgggacggcccgatggaccaggcctcgatcgacgccatgcgcacctggaagatccgcacggtccgggtgccgctgaacgaggagtgctggctgggcacggcggacgtgcccgcggcgtacggcggcgcggtctaccagacggccgtcaaggactacgtgaccctgctggtcaggaacggcatcacgccgatcgtcgagatgcactggaaccacggcctgtacaccggcccgtcgtccgggtgcagcgacgtcaaggcgacctgccagaagccgatgcccgacgcgcagtacgccccgtccttctggaccggggtggccggcgccttcaagggcgacgacgcggtcgtcttcgacctgttcaacgagccctacccggagcgggccaccggcgacgccaccagcggctggaagtgctggcgtgacggcggcacctgcaccggcatcggttacccggtggcgggcttccagagcctggtcaacgcggtccgggcgaccggggccaccaacgtgatcctggtcggcgggctggcctacgccaacgacctcagccagtggctcacctacaagccgagcgacccgctgaacaacctggccgccttcgcgcacatctacaacttcaacacgtgtgccaccaccgcctgctggaacagccagctggcgccggtcgccgcgcaggtcccgctgacactcagcgagatcggcgagaacgactgcgcccacgggttcatcgaccccctgatggactgggcggacgcgcaccaggtcggctacctgggctggacctggaacacctgggactgctcgaccggcccgtcgctgatcagcaaccacaacggcaccgccaccgccttcggccagggtctcaaggaccggctggccagggtgtccaactagggcggccgggatcgccggtcgcggcgcggacggcacctccgcggccggcgtgatcagcgcaggtcgacctcgaccccgtcctcggccagccaggcgaggaggtggtccatggtgatcgccgggcaccagtcgcggcggtcgtaaccggggaccaggtgcttgcgggccaccgccgagtcgtgccagacgagccggaagccgggcgccgcgccccagccgccgagcaggcagtcgtgcagcgctccggcgttccacccgaagtatccgcccgggccgttgatcgcctcgccgatcgcgcagtagaagccgtcctcgtcggtcacgtgccggccgtccaggtggtacgtccgcccggccggccggtccggccccggccggtggtgggccagcgcggcgccggcccactcgtgccgcagcgccgccgggtacgccgcccactgcccccgctcggtcggtcgtccggcctgccagcgctcccagatctcccgggccccgtgcgggcgaccgcctttgatcgcatccccgtaggagctcccgaagtcgacgtcgagcagcccgtcgccgagcaccgacgggcgcacggcggacacctcggcgcccagcccgctgtccagcatgtgcgtcgcggtgccgtcgtcggccacgctgaagatcgacgcgatgatcatccgccggtgccgggcggcgccccgggtgaacgcgtcgatcgcccgccgcagccgcggctcgggccggcagccgatcagcgtcgccggtgccggcacccgctgcggccgggaccggaacactccggacacgtcctggcaggtgccgaacgtctcctcgccctcgccggtgatcccggtcagcacgtagccgtcggcctccggggcccggtccggcccgcggcgccgcttgcggtgctccggatcgatccgcagccggccctccaggaccacgtcgaacaccccgtagccggtcgggctggccgacaccacggtgaggtcgagcaactcctcggtgcactcccagcactcccggggatgcttcgactccggccggtggatcgtctccagtccgatgttgcccagccagggcgcgccgtagccgtcgcaggccgcgcgcagccggccggccggggcgcagccgagcagcgtgtaccgctcgaccggcggctcacccgggtcggcgaacaggccgtcgatgtcggcgcacgccgccacgaccgcgtcgccgtcgtcgatgttctggtcgacgagaagccagggaaagccgccactcatcgggcgaccgtaccggtaagtctcccttgcggtgataccgagtgggtagcgtgccggtcaaagggggtaatacggtgaaaatcggcattcccagcgaggtcaagaacaacgagttccgggtggcgatcaccccggccggcgtgttcgagttcgcccgggccggacatcaggtgttcgttcagagcgcggccggactcggctcctcgatcaccgacgcggactaccgcgaggccggcgccaccatcctgcccgacgccgactcggtgtggtccgaagccgacctggtgctcaaggtcaaggagccggtggccagcgaataccatcggatgcggcccggccaggtgctgttcacctatctgcacctggccgcctcccgggagtgcaccgacgcgctgatggaacaccgggtgaccgggatcgcctacgagaccgtcgagctcgccgaccggtccctgccgctgctggccccgatgtccgaggtggccggtcggctcgcgccccaggtcggcgcgtaccacctgatgcgccagggcggcggccgcggcgtgctgatgggcggggtgcccggcgtctacgcggccaaggtggtggtgatcggggccggtgtgtccgggatgaacgcggccgcgatcgcgctcggcatgcaggccgaggtcaagctgctggaccgcaacatcgcccggctgcgggccgccgacgccgactatcgcgggcacctgcagacgatcgcctccaacgcgtacgagatcgaacgcgccgtgctcgacgcggacctggtggtgggcgcggtcctggtgcccggtgcgaaagcgccgacgctgatctccaacgatctggtggagcggatgaaaccgggcagcgtgctggtcgacatctcgatcgaccagggcggctgcttcgaggcgtcccggccgaccacccacgacgacccgacctaccgggtgcacggatcgatgttctactgcgtcgcgaacatgcccggggcggtgccgcacaccagcacctacgcgttgaccaacgtcaccctcccgtacgctctggaactggccaaccggggctggcgcgacgcgctgcgccacgaccgggcgctggccgccgggctcaacacccacgacggtcacgtcgtctacggcccggtggccgaggcgcacgggatgccggtgacgttgctgacggaggtgctgagctgacactcgaccgggcgataaaggcgtacctggaccatctcggcgtcgagcgtggactgtcccgcaacacgctcgcgtcgtaccgccgcgacctcgaccggtacgccgaacggctggtcgcggccggcatcgaggacctcgaccgggtccgcccggccgacgtgaccggccacctggccaccctgcgtgacgagggtctcgcctcgtcgtcggccgcccgggcgatcagcgcggtccgcggcctgcaccggttcgccgtccgcgaacgtctggtcgcgcaggacgtggcggccgacgtgcatccgcccgcgccaccccggcggctgccccgggcgctcgacaccgaccaggtcgaacgactgctcgcggtgcccgccgcggacaacccgttgggtctgcgggaccgggccctgctggagttcctctacggcaccggggcgcggatctccgaggcggtcggcgccgacatcgacgacctgcaactgggtgcggacagtgccgccacgctgcgcggcaagggtggccggacccggctcgtcccggtcggcggctacgcccgtaccgcgttgcaggcctatctggtgcgggcccggcccaccctggccgaggccgggcggggcaccccggcgatcttcctgaacgcccgtggcggccggctgtcccggcagagcgcctggaccgtgctgcaccgctgcgccaccgcggccggcctgccggtcgacgggccgcacgcggtcagcccgcacacgttgcgtcactcctacgccacgcatctgctcgacggcggggccgatgtgcgcgtcgttcaggaactgctgggacacgcctcggtcaccacgacacaggtgtatacgctggtgaccgtcgagcgcctgcgggaggtctacgcgacctcccacccgcgcgctcgttagaagctacgcacccttaggtgcgacacgccgaacggctgaccccgacagggcggcgcgtgtggcgtacagtcgggcatcgagtcgggagggggcgagggcgatgtcagggaacgaccgtgcggaggcctggaccaccgcgctccgcgatcagcagaattccctggatctgggcgccgacctcggtcctgccgaccccacggcgtacacgatgcgccgtccgatcccggagccgatgccgaccgatcggcacggccccgcgcggatcatcgctttggcgaaccagaaaggtggtgtcgggaagacgaccaccaccatcaatctgggcgccgccctggccgaatacggccgcaaggtgctcctggtcgacttcgacccgcagggcgcctgctcggtcgggctcggggtcaacccgcacaacctcgacctgagcatctacaacctgctcatgcaggacgacgtcaccaccgaggacgtcatcatcaagaccgatgtcgccgggctgcacctgctgccggccaacatcgacctctccgcggccgagatccagctggtcaacgaggtggcccgggagatggccctggcccgggcgctgcgctcggtccgcaaggagtacgacttcatcctgatcgactgccagccctcgctgggcctgctggcgatcaacgcgctcaccatcgcgcacggcgtgctcatcccgctggagtgcgagttcttctcgctgcgcggtgtcgccctgctgctcgacaccatcgacaaggtgcgcgagcggctcaacttcgacctggaactcgaaggcatcctcgccaccatgtacgactcccgcaccacccactgccgccaggtgctgcagcgcgtggtcgaggcgttcggcgacaaggtgtaccagacggtcatcaccaagacggtgaagttcccggagtcgaccgtggccggcgccccgatcactacgctggacccggcgtcctcgggcgcccgcaactaccgtcagctggctcgcgaggtcatcgcctccaaggcagaacgaggataggtcgccggttccgtgctgttcgcgctcgggacaccggtcgcgttcgccgcactggtcgtctccttcatcgctgccgtgatgctgcgcgccgtcgcgatccggttcaccgcacgcactgtcggcctcgccgagcgcggcgaccgtctcacccccagcctgcgccacgacctggacccgttcggtgcggtcggtgcggccctcggcggcatgggctggggcaagatcctcaccgtcgacgacgtgccgcgctggcggggccggggccgggcggcggcggtcttcgcggccggtccggtcgcctgcatcctcgccggtgagctgctggtcgcggcgttcgcgctgatctccgccgacgacttccggttccagagcctgacggtcggcatggtgttgcacggcgtcgacggcccgctgccgtacggccagcaggtgctgttgtcgttcggggtgggactgctggcgttcgggttgctcgcgctgatcccgatcccgccgctggacgggttcggcatcctgtacaacgcgatcccccgccccgggcacggaatgcagtggatgcggctgtggttcgaggacaagaacatcggcgtcctgctgctgctgatcttcagcctgttccccggtggctatccgctggtcctgatgatcctcgacgtgctcggccacttcttcctgcgcgcctgggcctgagacccccggacgcgggtcatcggcggtcctcggcggcggcgtggtgcaccggggtgaacacgttgccgttgtgcggcccgacccgctcccgggacagtccgccgcgtcgcatcagcggccccaccagcacgtcgtacagcgccggcgtcaccacgaaccccaagctgatgatcttgttcgcgatcccgacgttcaccgtgccccgcggccgccgcgcgcaccgcaggatcgccgccgccaccttctccggcgaatccaccggcggcggcggttgcccgtaccgccccgcgaagttggccgcccgccggtagatcggggtgtccaccgcccccggcgacaccaggcagacatggatgtcggcggcgtcccgggtctccagccgcaatgcccgaacgagtgcgcgcagcccccacttgctggtcacatacgagctcgtgtacggcgtcaccaccgtccccagcagcgacccgccgaagatcagcaccccgcgccgctgccgccggaacgtctccagtgcgacccgtgcgacgttcgccgccccgagcaggtcgacccgcaccacctggtcgaacacctcgaccggcacgtcctcgaaccgcccgtacgccatcaccgccgcggtgtgcacccagacgtccacgcggtcgacggcggcggcgacctcccgcaccatcgccggctcggtgacatcggcgacgacggtcaccacccgcgccccgagcgcgcggcactcggcggcgaccgtttccagcgcttccgcggaccgggcggcgagcgcgagccgtgcgccgcatcgggcgaacgcgagcgcgctggcccgtccgacgccgctggaagctccggtgatcacgactgtcgggggcatgaccggctggtaccccgagccgtccggcgcaacccccgcgcgctcgcccgcgtcgtccgtccaccgtgcccggccctcgtcgtgagcgctggcggccggtgccggcgagggcgggcatggtgggatgggacggtggggatgggcagagccaagcggatctggttccggctgctgaagcacacgatcaaccgcccggcgatcgccacggtccaccgcggctggggcccgctgtcggtcgtccagcacgtcggccgccgcaccggcacccgctacgagaccccgctgctcctggtccggcgcggcccggatttcatcgccgaactcacctacggcccggacgtcgcctggctgcgcaacgccgaggcggccggcggctgcacggtcctgcaccgcggcgccgcctaccgcatcgtcggcatcgacgacttcccggccggtgccggtgttcgcgctttcggggttcccgccgggctcgtcctgcggctgacccgccgccggcacttccggatcctccgtggggtccgcgggcacgcgccatgggcggaccccggtgccggcccggccggcaaacggtggccttgatcgatgccggcggggacgctccggtgtcgtcagccctcggcgcgacgggtgcgctccggtgttgtcagccctcggcgcgacgggtgcgctccggtgttgtcagccgtcggcgcgacgggtgccgaccagccacgccgacagccaggacaccccgatggccagcacgaacagggacacgtcgagaacctgttccggcacgaaggcgcgcagtgccaccggcaccgaccccagggcgtagagcgccagtgcgcctcggggcgggatcgcggtggacgccagggtgatggcgaagcccaccgatcccagcaggaacaggatggacgcgacggtcagcgccacgcccagcgggccggcgcgcagatccgctatctgatccgtgctcagccgggagaacaccaggttgatgacgaactcgacgccgacgagcgcggccagcgcgacgtagttcaccgcgaaggtgagccggccgagccggccgatccgcccctcgcagatcaggtagagggcggtgatcagggccagggcgaagacctcggccaacggtgcgagcaactgcgtcaccgcggacgtcggaacgaggtgcgcgcgcttggccgcgttgaccacgagcacggtggcgccgagcagaccggcgacgccggcgaggcgctgcagggaacgggacagccgcacgggtgcggtggtgaccacggtgtgtctcctccgggtggtagagcatcagtcgctgcagtctcgcactagttactgcgaaaacgcaatacttgattggtatgctgctccccatgccgggccccaagaacgttctcgtcgacatctggctgctctcctcggtggccaccgcactcgtcgccgaggagctcgccgacagcccgttgtccgtggacgagttcgcgctgtacggcctggtcagcgacctcggtccggtgaccgccacccagctgtcccagtggaccggcatgtcgcccaccacgctgtcggccatgctgcgccgctgccaggcgcgcggtgagctggcccgcacgcccaatgccgccgaccggcgcagcacgctggtggaactgacggagcagggacgcgcggtgtacggcgcggccctcccggcgctggccgtcgcgcagcaacggctcgccgagcacctcgacctgccggacgacgatgcccgggccaccctccagcgggtggacgcggccacccgcgcggcgttgaggctgccgccccggccctatcgcgtcagcgcgccgccggtcaccggtggcctgccggccggcaccgccgggttgacggccgaccaggaggccgaggtgcgggccttcgcggcctggctgcgctaccgcgacgcggcggggtgacggctgccgcggctttcgcacccgtgaccgcggtggacggctgggctgccgcggctttcgcacccgtggccgcggtggtcggcggggtggtcaccgccggttgcggccgcggtcaaggtcgccgcggcggttctccgcggtgcggcgggtgcgccggagggcctgctgccaggcgaccgtggcgaccgcccggaacgcgccgggtgacatcgcgatgcggcggcccaggcggtcggcgcggtcgaagatctccgggcgggccttggacgggtggccggcgtcgaacggtggccgcgggtcgtactcgatgaagagctgcaccgtctcggcgtggtcgcggccggcgatctcgccggtcagccacagcgccaggtccagcccggccgacaccccggccgcggtgaggatcctgccggaccggaccacgcggtcgtcgcggcgggcggcggcgccgaaggacttcagcgcgtcctgggcgatccagtgcgtcgtcgccgggtggccccgcaggatcccggcggcggccaggatcagtgcgcccgagcagaccgacgtggtccacgtcgtcgtctcgtggacccgccgcagccaatcggtgagctgccggtcgaccatcgccgtcgcggtgttcggcccggagccgggcaccagcaccaggtcgggccgcggcgtctcgtcgtagccgtgggtgatcccgaggaccagcaccccgctgtcggtgaccaccggcccgggctccgccccgacgaagcgcacctcgctgtccggcaggaaccggaggatctcgtagggcccgatggcgtccagggcggtcatccccgggtagagcacgatggcgatctgcatgccgcgatgctgtgtcgcgccaccacccgcacgcccgcccgggcggggggaaggtccggattcgtgggcagccgggccggatccctgtgatcatcccggggaggggaggtccgcgaggggccgtagccgggcgggtcgccgggtccggtaccgggacgggggcatcccgtagcggtcgaggaacgcctgccgcagcgactcggtcgacccgaaaccgcaccgccgggcgacggcggccatcggcagcccggtcgacccgagcagatgggcggccgcctcggtccgcgcccgtcgcacgtattgcgccggggtcagctgcacgtaggcctggaacagccgggtcagatgccgctcgctcaccccgaaccgccgggccagcgccccgctgctcaggtcgtcggtgagatgcccggcgacgtggtcggtggcccggcggcacacgaagtcgtcggccccgcgccgggccaggaacatgctgatctgcgcctgcccaccgggccgctgcaggtaggcgaccgtccccagggccaccccgcgcgcgatcgtcggcccgtggtcctcctcgatgaaggcgagggtgaggtcgagcgcgctggtcaccccgccggaggtcgccacccgcccgtcgcggatccacaccggctcggcgtcgaccaggacgtccgggtatcgggcggccagctccgccgcgtaccgccaatgggtcgtcgctcttcgtccggtgagcagcccggcggcggcgagcacggtggagccggtgcagaccgaggcgatgcggcgggcgaggggcgccaaccggcggacgtgtccgacgacgatcgggctggccgccgcctgctcgtgcccgttgccgccggtgaccagcagggtgtcgagcggttcgttgatccgttcgagctcggcaccggcgtcgaggcgcagcccggagtcgcaggcgaccggacggccgcccggcgtggccagcacggtgcggtagggcgggtcggcgccgatccggttcgcgatggcgagcgccgaggtgacgcaggcgatgtcgagcagctccgacccgtcataggcgaccaccaggaagagcatggcggccagtgtagggcgcaccgaacagttgaccgtttcggaagctcctgagcgaaaagccggtttccggtagcgtccgatgacgtggtgacgaccctgtgcttccgttgcgggggtgacgtcgcggtggagcggcagtggtgcggttactgcgccgcgccggtcgtctcggccgcgccgccgacgcccaccgcgcccccggcgcccgttccggatcaccaccatccgggtgtacgccggagaggccccgccccgctcatcgcgctcctgctgctgctcgccgtgggtgtgatggcgatcgcggtgacccgccgggtcgccgacgatccgcggagcgtcgccgcgcgctacttcgacgccctggccgacggggacgccaccgccgccctgcgcctggtggccggctccgtcgacctcgacacctcgcagtacccgctgctcagcgacaccgccctgaaggcccgcgcgcaccgcccccgcgacgcggaggtccgcgcgacgaccgacgccggcacccagttcggcgccccggcccggatcgtccaggtcgactatcgcgccgacgaccgggcgatcaccgagaacgtcctggcggtccaggagaaccaccgctggcggttgcggttgccgttcgtccggctcgccgtggccgggcagcgcggccggcaggtgaccgtgaacggggtcgggctcggcgccgccggccgggtgaccgtggccttccccggcgcctacgaggcggtcgccgccccggacacgctgttcggcgagagccgggcgaccggattcgtgcagaacggtgggttcgactacgtcgcaccgctgcagttcggggtgccggagctggtcgacggcgctctcgacgacatccgtgggcaggtgcgcgccgggctggaccgctgcgcggcgagcaccgccgcgcagccgcccggctgcccgttcgggctgaacgtaccgggtaccggcgtcgcggtgcgctggacgatcaccgcgtatccgcaggccgaggtgttcgtcgacggtggctttctggccgggtcgggggtgcggatcaccggctggggacaggtgcactggatcgccggctacaccgacccggccgggcggaagcggtctgcgaacgccgacctgcgcttcccgctggccggagccgcccaggcgacaccgaccggcatccaggtgacgctgatctgatggaggaccgatgagcatctccacgctggggccgggcaacggcgacgtcgcctaccggatgcagagcctgcggcacggcccggccgagccggtgctggaccgtggtgtaccggccgggacgctgctgcggctctggctgtgggcggccgtgcccgcactgatcgtcggggcggtcttcggcttcctggcgctggtgctcttcgcggtctccgggcccggcctgagcgacgggaccacgcccggcgacgggatgctgtcggccggctcgatgctcggcttcatcgtgttctggacggtgctgctggcggtccggatcgacgagccggtgggggagtggaccaccctgctggaggagcgctggcagggtgcggactcggcgtacgcggcgatctacgcgaccctgcggcggcgcgggatcccggtggaggtcgacgccgtacggctgcgcagtgatctgctgccgccggaggtggtcgacaaccgcctgctgatcgcggaccgcgactaccgcatcgcggtctcgatcttcccgtacggaagcgggctcagcgtgggctggacgatgtggcgcgggcggcgcggggcgacggtgctcgggaacttcctgcgggacgtcggtgccggcatggtcgggcagggtgtgcgggccgaggatctgctgcgcggggagcgggtgcgggcgttgcgggaggcggtgcacgcggcggtccgggagggcgccgaggtggccgcgcagggtctcgtggtgccgatcgggccggcgttcggggcggaggtgccgatcctggatctgcgtacgtcggtgccggctttccccgccttcgccgcgccgccggccccaccggccacggccccaccggccacggccccaccggccactgccccggccccggccgcggtgccgccggccccggcggtggtggagtcggacgagcccgggccgccggtgagctgatgacatcggtcgttcgggcagcaacccgcgtgacccggtgacgttgatctgatcgtgagcccggagcacgttgtcacaggcatggtctacggtcggcacgtgcttgaagagcccgccccgccggcaccggatgccgccgtccccgactccggcggcttcaccgtgcggctgcacaacttcgagggccccttcgacctgctgctgcagctgatcggcaagcacaagctggatgtcaccgaggtggccctgcaccaggtcaccgacgagttcatcgcgtacatccgcggcatgggcgacgactgggatctcgacgagacgagcgagttcctgctggtcgccgccaccctgctcgatctgaaggcggcccgtctgctgccctcggccgaggtggaggacgaggaggacctggccctgctggaggcccgcgacctgctcttcgcccgcctcctgcagtacaaggcgtacaaggaggccgccgcgcacctggccgagctggaggcgaccggcgcgcgccgctggccgcgcctggtcaccctggaggagcggtatgcgcaggcgctgccggacctggtcctcgggatcggcccgcagcggctgttcaagctggcgctcaagcagttcaccccgaaaccggggccgccgcaggtctcgatcgcgcacatccaccaggtccgggtcagtgtccgggagcacgccgagctgctgcgcgaccggttgcgccgggccggtctggccagtttcagcctgctcgtcgccgactgtgagagcaccctggaggtggtcgcccggttcctcgcgctgctggagctctatcggcagaatctgatcgatttcgagcagccggtgtcgctggacgagctgaccgttcgctggatcggcggtgaccgcgaggcggagctcaccgtcgacgactacgagggcagcccggagaagatcaccgacaagccggaccgttcgggggacccgggcgccgaccggcttgacgcggtcgccccgggcagtgatcttggggccgtggaggagagtcagtgagcgacgagcagtccgagtccctggccgcgcagatgggcgcgtgggtgcccccgtgggagcgccgccgcgacgagcccgaccgtgagttccaggacgcggtggacgcgccgcaggacatcccgggacaggagccggagccgacggagatcgaggtcgagccggagatccccgtgcccgacccgatcgaggaggcccccgagccgcgggagccggccaccccggtcgacgaccccggcgcctacctggccgggttccaggacgccgcggccgctgtcgcggagatcaccccggtcgtggtgccggctcaggccgccgccccggaggccgtcgagcgctcgctcgacgacgccgagctgaccgccgcgctggaggccatcctgctggtcgtcgacgagccgaccagcgagctgaagctggccgaggtgaccgagcagccggtggagcgggtcacccgcctgctcgacgacgtctcggcgcgctacaccgcggccggtcacggtttcgatctgcgccgcgcggccggcggctggcggctgtacacccgtccggagtacgcggcgtacgtcgagcgcttcgtcctcgacggccagtccgtccggctcacccaggccgcgctggagacactcgccgtggtcgcctacaagcagccggtgaccaggtcgcgcatctcggccatccgcggtgtgaactgtgacggcgtcatgcgtacgctggtcactcgcggcctgatcgaggaagtcggcaccgagccggaaaccggggcatacctgtaccggaccaccagcctcttcctggagaagctcggcctcaactcggtcgatcagctgccgccgctcgccccgttcctgcccgacgatgtggaagaagtacttgatgcctcaggctgacaccgccgaacgcctccagaaagtcctggcggcggccggtgttggatcccggcgcgcctgcgaagacctgatcttccggcggcgcgtcacggtcaacggccgggtcgccaaactcggcgacaaggtcgatccggccactgccgagatctacgtcgacgggcagcgggtgatcaccaacaccaagctggtctacgtcgcgctgaacaagccgcggggcgtggtctccagcctcgacgacgacaagggccgcaccgagctcgccgacttcctcgacgacaacttcgagcagcggctgttccacgtcggccggctcgacgccgactcggaggggctgttgctgctcaccaacgacggcgggctggcccacaagctgatgcacccgtcgtacggcgtctccaagacctatctcgccgaggtggtcggcccgctgccgcgcaccgtcggccgggccctgcaggccggcgtgatgctggaggacggtccggcgaaggtggacgcgttccgcctggtcgacgccgtcggcaagaccgcgcaggtggagatcaccctgcacgagggccgcaagcacatcgtgcggcggatgatggacgaggtgggtcacccggtgacccggctgatccgcaccgcggtcggcccgatccggctcggtgacctgcgccccggcggtttccgccacctgtcgaacgccgaggtcgccgccctgttcaaggccgtcggcgacgacgaggcctgatcgtccgggcgccggccgggctgagccggcgcccgcacgcggtcagcagccgatctcggcgcccggcttgtccttggacagcgcggtcatcaccaccaggacccggttcaccccggtgttctccttcagcggcgtcaccggcgcgcagtcgaactcgcggccggtggtggccacccggtacgactcgggcaggttctgctcggtcacgtagtcgggcagcggctgcccggcccgggcgtaggtgtccttcatctcggcgtacgcctcggcccggttctgcaggtgcacgtcgcccttggtcggcagcttcttcagcgccgcctggaccgcgtccttctgctgctgggtcgcggtctccttgaggaacaccgagacgttgaactcccgctgcggctgcgcccgccagcccgccaggtagagcccgccgaaggtcgccccggcgccgaccaccagcgcgatcagggccggcagcagccggccgggaccccgcttcggctcgacccgcggcatgaactccggtgactgatcagtaacttcgctcacgatcgcaggacgatacccggtcgtcactggtccaggaaggtcttcagcgcggcgttgaacgcctccggctgctcgaggttcggcaggtggccggcgttgtcgacgacggtcagtgcggacgcggggatcagccggtgcagtgactcggcgtcggcgaccggggtgaactcgtcgtcgcgtccgaccacgatcagtgtcggcacctcgacccgggtgagcagctcggtgtagtcgcggcgttcggcccggccgcgcagggccgcggcggcgccctccggagcggtgttcagcatcatggcgtacacgtgccgggcgacctccggcatggccgcgacgttgtaggcggccatcatcctgggcaggttctcggcggcgtagccgcccatcccctcggccagcagccggtcggcgacccggttgcggtgcgcgtgtccctccggcgtctcgccctgggcgaaggtgtcggccagcaccagcccggcgatccggtcggcgaacagccggtggcactccatcacgatctggccgcccatcgacaggccgcccagcaccacctcgtcgagccccaggtggtcgacgagggcgaaggtgtcccgggcgaacatctccagggtggtctttcccggcaccaccgtgctgccgccgtagccgcgcaggtcggcggcgaccacccggtagccgatcgcggtcagcgcggcgacctgcggccaccacatcgaccggtcgaacgggtggccgtgcaccagcacgacggccgggccgtcaccgtagtcgtcgtagctgaccgtgatcccgttgacgtccgccgagcttgtcatggccacacggtaggaaggcggctgtcgattgtgaagatccaatagcgtcgtggtggcacgcgctaccccgcggtccgctccagggtgatccggtcgatctcggtgtgcgcctggccggagccgggcagcgcgtcggcgagggtccgcacggtgagcgtggtgcgtccgccggcgagccggggcggcaccacgtcgacggcgatgaacgcgtacccgtcgtagcggacctgcgaccagtccaccgactcgggcacccggacgcccttggtcgccttgccgttgtgctcggcccagaagtagctgttggcgaccgtggacgacgtgttctcccgcccgttggcccggtgcccgcgataccgctggccctcgggcagcttctgctcgcccttcgggacgacccccggcggcgcgggtgccggggcacccggcgccggacggaacggatagcgggggcggccaccggagccgacgcagacgtacgtcgtcccgtccttctccggatgcaccgtcgcgccgtccggcgccgccctggtccgccggccgtgtctgatcgggtcggtccgctcgaacaggtggttgtgtccctgcacggccagatccacccggtaccgggtgaacagcggctcgatcgcggcccgcaccccgccgtcggaggcgtggttgtgcgctgtggagaacgcgcagtggtggaagaacgcgacgatgaagtccaccccggagccggccgcccgccagcgcttgagcgtgtccttgagccaggccacctgcgcgccgccggagtaaccggtgttcgactgcagctcccaggacagctcgttggcgtccagcgagatcagcccgacgttgccgtacacgaagcggtacaccgacgggcagccccgcggtccggtcgccgggaagtccaggcgttgcacgtgaccgccgtacccgtgggtcgggctgtcaccgagaacggcggtgttgccgtacaccggttccatgtcgtggttgccggtggcgaacatccacggtgtgtacgccgcctgcggctcgatctggttcaggaacacgtcccagacgttcgggttgaacaggttcctcccggccggcgccttcccggtcagcgccgtggtgtcgtcggccggcagcccggtcccggacgtgttggcgtagcagatgtccccggccagcagcgtgaacgcgggtcgctgggtgtccatcaaccgggtgatggtggcggccggcgtccggtcggtcccgtacttcccggcaatcggatcgttcggcccgtacgcgttgtcgtcgaagatcccggccggccagacccgcgccggatcccggggcgcggtgttcgtgccgacgtcggcgaacgcggtgaaggtgaacggctcggcggcggccggcgcggtggtgaaatgggcgtcgccggtcaccgtcccgtccgagagccgcacccggtagtggtagaccgtgttcggcttcagcccggtgatccgggccttggcgtagaactggctggcgaccggcccgcccgggatcgcgtactgcccgaccagatgggtgaccgccgcctcgacccgggtgccgtagttgccgggcgcgtcgccgacgtcgacgtacgcccgcaaggcggccggaagtgatccggtgctgctgaccagctgcgcggtgaccgccatcgcgtccagcggtatgtcaccggcccccgggacgaaggacagatgccgcccggagaccaccacaccggcgccgccggtggtgccacccgccgccgcgaaggcctgccgggccagccggaactggctgcccacgccggccgcgaccgcggtcagcaacagcgaccggcgggtcaccgcgcggcgggcgagaagctggtcgttccatgcgctgaactcgtcgaccgtgaacgtcacacgccgtacgctaatccgttttgagacgttttttctggatctttcccatcgcgttgcggggcagctccggcaccaggtgcaccgttcgaggccgtttgtgcgcggccagccgctccgccacccaggcgatcagctccaccggggcgaccgggtcggcgaccacgaacgcggtcacctgctcacccagatcggggtgcggcgtgcccaccacggccgcctcgtgcaccgccgggtgcagcagcaacgcgtcctcgacctcgccggcgccgatccggtagccgccactcttgatcaggtcggtggaggcgcggccgacgatccggtgccagccgtccgggccgatcgtggcgacatcaccggtggggaaccagccgtcgaccagctcggccgggcggacgccggcaccgcgcagatagccgtccagcagggtgggaccgcacacctgcaggtggccgatgctgacaccgtcgtcgggcagcggggtgccggtctcgtcgaccaggcgggtgtggacgccgtccagcgggatgcccacctgcccggcccggcggtcgccgtcggcccgggcgctgaccgtgatcagggtttcggtcatgccgtaacgctcgaccggggactggccggtcagctcgtgcagggcctcgaagaccgggacgggcagcggggcgctgccggaaaccagcaggcgggccttggccagggcgcgggcccggtccggggcggcggcgatccgggaccagacggtggggacgccgaaatacatggtgccgggagtgccggcgtacgcctcgggcgtgggtttcccggtgtggcgcagtctcgcgccgatccgtagcgggccgaggacgcccaggacgaggccgtggacgtggtagagcgggaggccgtggacgaggacgtcgtccgcggtccactgccaggcggtggccagggcgtccaggtcggcggcgatcgcccggcgggagatcaccacgcctttgggggcgccggtggtgccgctcgtgtagaggacgagggcgggggtgttcgggccgggttccgccggcgtctcatccgatttttcgctcaggtcgtacgtgatgaggtcggcaccggagtcgctgaggatgtgggcccgctccagctcaccggcgtccggtggaatcgggacgatcggcacgccggccagcaatgccgcggtgaccgtgacgatcgtcgacagatacggagtggcttcgaccgcgaccatccgacggccggcgatcctggccgccagggcgttggccatcgcgagcagctcgtgccggctgaccgaccggtccacggtggtgacgaagccgggaacgtccgtgtcccgcaacagcgcggtgagcagaggcatgggtggatcatgccaggggatatccggttgccgccgcgctcggggtcggcaaaactgtcccgcatgacgtactgacgaatctccccggtttccttttctcgcctcttcttcctgggaaagagcgtcagttttgtctgccagtgtgtctgttttcgcttcaccctccagctggatcgagtcgagcgcgctcgaccagtgccaccaggtcgccgcgctgcccggcatgcgccacgtggccggcatgcccgacctgcaccccggcaagggggccccgatcggcgcggcgatgctgtcgtcggtcctctacccgctgctggtcggatccgacatcggctgcggcatcgcggtcttcccgttccggctcaaacgcgccgtgccggagaagctcgccgcccggttccccgacctggacgtgcccgaccctttccacatgccgccggttattgagatccccgatccgttcggcacggccggccccgccctcaccgacagcctcggcacggtcggtcgtggcaaccatttcgtcgaactggcccgcgtcgacaccgttttcgacgctgaccacgccacccgcctgggcctgtcccgcggcgacctcgtgctgatcgtccacagtggttcccgcggtctcggcgagcggatcctgcgcgcccacaccgaggtgcacggcgccggcccggccgccgaccccgaggcgtacctgtccgcccacgacgccgccgtccgctggggctcgctgaaccgccgggtgatgggcgcccgggtcgcggacgccctcggcgccccggtcgagcccccgatcatcgacgagtgtcacaactccgtcgagatccgcgacggcctctacctgcaccgcaagggcgccgccaacggcgacggccgcgacgtcctgatcgccggcacccgcggcaccccgtcgtttctggtcgccggccacgccggcgccgacgccggcttctccgtggcccacggcgccggccgcaagatgtcccgagccgacgccctccggcgcggcaaagtcaaacacaccatcgaagaattacgccgtacgccgttgggctcccacgtggtctgcgccgaccggcagttgctgttcgaggaggcgccgagcgcctacaagcgcatcgagcaggtgatcggggacctgaccggccacgccctggccagccggatagccagcaccgttcccctggtcacctacaagaccgcccacggcggccggaaatgaaccgccggacacggatcggtcagggtgcttctgtcggtcccggttcgtccgtcgtcgcttccggtggtgggcgggcggtcgggtccggtggtgcttccggtggtgggcgggccctcgggtcggatggtgcctccggcggcggtcgggccgttgcgtccggtggtgaggcggtcgcgcgcgttcagctgctgctgtcggcgggtcgcgggccgcaggagtgttcgtgggcggtcgcccagctggcccgccgcctggaggcggacgcgcgtcgccatcggctcgccaccgcgcgcctcgcatcgatgcccggcgagcaccccgcgacgtaccgttccctgctggtgcgcgtctgcggcccggccgacgcggtccgcgcgttcgccgcctcctggaccggcaccctgtgctggcaggcgccgagcccctaccgcaccggccccggccgcaagaactggtatgtcaccgcccagcccggcgacctcgacacaccacacaccgccttccgggaatccgacgtggacatcgtcccggtccgcaccggcggaccgggcggccagcaccgcaacaaggccagcaccgccgtccgcgccacccaccgcccgtccggcctggtcgtggtcgtcgacacggaacgccggctctccctgaaccgtgccgccgcgctgcgcctgctccgcgaccgcctccgccggctcgacgaggccgccgcccggcaggcggtcacctcccgctggcgtctgcacgacgacctggtccgcggcgatccgacccgtgtggagcgccccttacactcgtgacatgggcgctactgtaagtgacctgatccgtatcgtcagtgacgatcatcataacggggacatccccctggtctgggacgcctaccgattcgccgaccgtgcccaccgcgggcaacgccgccgcaccggcgaccggctgatcacccacccggtcgcggtcgcggcgatcgtcgcggaacacggcggctcaaccccggcggtgtgcgccgccctgctgcacgacgtcatcgacgacgcccgcatccgcccgtcgaccgtgcgccacgagttcggtaccaccatcgccgacctggtcgacgacgtcgccgcccgagtcgtccgcgacctcgacctgtccccgcccacaacgccccctccccgccggaacccggttccgctgcgtcgcgccccggttgcaccaggtcgtgacctgcttccggccggccgtgacctgcttccggccggccgtgaccgaatttcggccaaccgtgaccgaatttcggctggccgtgaccgaatttcggcccgccgtgacctgatgctgatcactgccgctgatcggttgcacaacctgcggaccgtccagccgctgccaccatcccggcagcgggcggtgtccctcgacaccctgacgttccatgtgccactcgcccggcacctgcgggcccccgcgatcgtgacggagctgaccgacctggcctgccggcatctgatcaccgccgaccggcccggcctccggatccgatcccggcgcctgttcaccgtcgcccgccgcaccgacccccgctggatcaccgagaccaccgcggccctcggcggcggcgccctcttgaccagcggcatccttcccgagtgggccgtcgccaccggcggcgccggcctgctgaccctgctcaccgccgcactcttcagccgcgacccgaaggccgccgatcgtctcgcctcgctgatccgcgcctggcgccgcgactgaccggccgccgccctggcgatccggtcggcacctggtagccgtcccatgacccgggccccacccgccgtgcaggcgacgggccaggtcgtcatgcggtgtgacctgacggtggccaccgccccctcgctcgggtgcggtcgccgatcctccagcgcggtggcaactcccgtcccggggccgagccggcgggcgtgcagcagctgggccagggcgggggcgagcaccggccggtgcgtgccaggcagtggagcggtcccgggtagcgcgagccgcggcgaggtagggccccacggtgggcgcgggccggttcgggtcatcgccgccgcccaccgatccggactgatccgtcagagggacatcccggccagtccggcgaaccagcgggtgatcatcggcaccgcgaggagctcggatccctcgtggaccatgccgtcgtacgaggtgtccaccccggcgtcgaccaccgggacccggacgccgtgcgcggcgaacgacccccggcaggccgtcgtgttgccggtgaccgcctgctcgtcgccggggctgaagtacagccggaccggcaccccgggcgtccactcgcagacgctgtccgcctcgcgcagcgccgccgcgaaccggcctcgcgggtgcgacagcaggtcacggccggccggggtgagcagcagggcgggcgactcgggcaccccggcgagcacctgcgcaccgggatggccggcgtcgaacaggtcgccgatactgacgtagtccgcggtgaacaccacggccggatccggatagatgtcgtgccaccggtcgtacgaggtcagcaggtacgccaggtaggccgccgccagccgcggcaccaccccggacgccgggtccagcgccgccgggatctccacccggcgcaacgcgtacccaccgctgatcggcgcgatcgcggccgcccggaaccacgggtcggccccggaccgcagcgcccgggccagcccgagcgcggccgacgcgccctgcgagaagcccgacgcgtacacctcccggtccagctcacggccctgcccggcggtgaacgtgcgggccgcccggagcaggtcgagcgacgcgctcgtctcggtcggcacgtccatccacgggtgcgggccggtgccggcgccgagccccagatagtcgggcgcgaccgcggcgaagccggccgacgcgaacgagatcgccggcccggtcaggaacgggtcggtgcccagtgacggggcatccccgcgatacaccgacgtgccgtgcccgaacgacaccgtgcgcaggtgcgacgagccgtcgagcgggagcacgagcagcccgctcgcggtggtgggccggccgttcggatcgaccgtgcggtagatgagctggtgcaggctcaccccgtaccgcgcaatggtggcgtcgaagtggttggccgcgaggaaggccgcgacctgatcccgggactggtacgtcgtgacgggatgggccgcgaccagcctgccccgcgcgaccggcgacggcccggcggcagcgggcgtgccgaagcccgccgctgccaccgccgccagcaggaccgttgcgatggttcgccgaagtgtccgcatgcgacagacggtaggcgcgtggccggcccggcacattggggtagacccgagaaatcagggtggagctgtccctaccgggttatcccgatggtcgctgtgaccagggagatcagcgctatgatccgggctgcgaaggtacggacggtatcggcccgatcggcacggccgaccggaatcggtagggccgggagtgctcgtaccattcggggggatgcgccggtatgcggcacggcccgtcgggcaatcggcggtctgctgtcgacgtacaccgcaatcgtcaaggaccggccacggccgcgagtggtgcgggattttgtgcgccaccggcgcgctcttcgcttcgcgattattcggcgtacgccgtgcggcaggcgttgtcgctgccagtgaccccggcgccggaacgggttgcgggcgtggggagcgacacccaggttcgccggaggcttcggcggcgggcacaatgggagggttgttgcggcggggacgaggaggagcggtggcgctagaggtacggccggcgaggtgcgtcgtggcagtcgacggcccgtccggctcgggcaagtccaccgtctcccggcgcctggcctccgcggtcgacggcgtctacctggacaccggcgcgatgtaccgggcggtgacctgggcggtgctgcaggcgggcgcggacctgaccgacccggagtcgatcaccaagatcgccctggagaccgaactgtcgatcggcaccgacccgcaggcaccgcacttcgccgccaacgggacgaacgtcgacgcaccgatccgcggccccgaggtgaccgccgcggtctccgccgtcgccgcggtcccggccgtgcgtaaacacctggtcgcgctgcagcaggcgatcatcgcgggccagccgcggatcgtcgtcgagggccgcgacatcgcctccgtcgtcgcacccggcgccgacctcaaggtatatctgaccgcctcgtccgccgcccgcgcccagcggcgcagcgccgaggacgccaccgatgtggcggccaccgaggcggacctgacccgccgcgacacgctggactccagccgcgccaccgacccgctgcgccaggcctccgacgccatcgaggtggacaccaccggaatgggcatcgacgaggtcgtccagcaccttttgactctgctgaacagcaaggtaagtaagtgactgaatttcccgccgacctcgacatcaacgatttcgagggtggcctcgacttcccctcccccgcgggggaggacacctccgactccttctccggcccggtgccggtggtcgccgtcgtcggccgtcccaacgtcggcaagtcgacgctggtcaaccggatcatcggccgccgccaggcggtcgtcgaggacgtgcccggcgtcacccgcgaccgggtgccctacgacgcgtcctggaccggccgccgattcaccgtcgtcgacaccggcggctgggaacccgacgccaaggaccgggccgccgccatcgccgcccaggccgagatcgccgtccagaccgccgacgtggtgatcttcgtggtcgacgtgacggtcggcgccaccgacgtcgacgaggccgccgtcaagatgctgcgccgcagccacaaaccggtcatcctggtcgccaacaaggccgacaaccagaacctcgaactcgaggcggtctcgctgtggtccctcggcctcggcgaaccccaccccatctcggccctgcacggccgtggctccggcgacctgctcgacgacatcctcgacgcgctcccgcccacccccgccgtgatcgagggcgccccgcgcggcccccgccggatcgccctcgtcggccgccccaacgtcggcaagtccagcctgctcaaccgcctcgccaacgaggaacgcgcggtcgtcgactcggtcgccggcaccaccgtcgacccggtcgacagcctggtccagatggacggcgaaatctggcagctggtcgacacggccggcctgcgcaagcgcgtccaccaggcctccggcacggagtactacgcctcactgcgcaccgccggcgccgtcgaggccgccgaggtcgccgtggtgctgctcgactccggcgaggtcatcagcgaacaggaccagcgcgtcatcacccaggtgatcgaagccggccgggccctggtcatcgccttcaacaagtgggacctggtcgacgccgaccgccggttctacctggacaaggagatcgaccgcgacctcaaacgggtgacctgggcagtccgcgtcaacatctccgccaagaccggccgggccgtcgacaagatcgccccagcggtacgccgtgccctggcctcgtgggagcagcgcatcccgaccggggcgctcaaccagtggctcaccgccctcacgcaggccaccccccacccggtccgcggcggccgcgccccccgcgcgctcttcgcgacccaggcaggcgtggccccgccgcgcttcgtcctgttcaccaccggcccgttcgacgcgggctacctgcgcttcatcgaacgcaagctccgagaggagttcggcttcgaggggacgccgatcgagctgtccgtgaaaccccgcaagaagacggggccgggggggcgggggaaagctcatgggtgaggttggtaagctttaggagatgtcgcgccgggctggggttcggggcgggatcgggctgtagcgcagcttggtagcgcacttgactagctagctagggccgctgccagcagcaacggccgcaaacccgccactgccgccgacgacggcgacgacatcaaccagtggatctgaggagcacccgtatgagcatcttcgacctctacggtcagacccagcacctcgaacgcctcgatccgcagggcgtcaccgacttcgtcaacgacgaactgatcgtcagcgacatcgactcccggcaggccctggaagacctggcctggatgaccgccgggctgttcagcgacggcaacggactcgcccagctctacatcgacgacggctgggacgtgaccgacgggagccatcacgggctcaccgaacaacagcggggcgagctgatcgcccgcctgggaaccatcgcgcacaactgcggccagctcgtggccgaactctgccgccgcgcgtcggccgtgaaacgcgaatccgggtgggacccgctcgtcaccaccgaacccatctgacccctaccgcagggcgctccaccgcgagcgtcctgccctttcacctccggaagggaggcgaagctcgtgagcaccatcgcctgcgatccgctcggcaccgaccgggtgcctgtcgggcctggcatgtcgatgttcgatcccctgttcatcggcatcgacgagtttggcgagcacgtcacgctcgacatcgtctaccacaacctgcttaccgctggtgagcccggcggcggcaagtccggcctgctcaacctcgtcgcggcgaccgccgcactcagcgacaacacccgcctgatcggcatggacggcaaatgggtcgaactcggcccctgggaaccgatcatggacgccttcatcggcgacgacatcgacctggccatcaagaccgtgcgtcgcctgctcaccgtcgcccgcaaccgctaccgctggctgctcgccaaccgccgccgcaaaatcacacgggaggacaacctctccacgatcatcaccatcatcgacgagatcgcgatgttctcgaccgtgctaggcaccaaggcccaacaggaagagttctcgaccctgctccggggcctggtcgctctgggccgcgcctgcgccatgcccgtcgtcggcgccacccagcgcccctcctgggacatcatccccgccagcctgcgggacctgttcggctaccgctgcgccttccggtgcaccaccgtcggctcctccgacgtcatcctcggctccggcctcgcagaggtcggcttcgacgcctccaccatcagccccgacaaccccggcgaagccctgctgcgcgccgagaagaagctcccgtacccgatcaaggcggcctggctgtccgacgacgacatctacgccatcgccgactatgccgcctggctacgccgccctaccaatcccgccaccacgacctcctacaccgggcgcacccaatgggagatggcggcatgaccgaaacccgcgctcaggccatcaccggcgtaatcgctggaaccgccaccacgaccgcctacctcgccggccttctcgtcggccacctcacccggcaccaggcaccggtcggtgtcctcgccctggcgatcaccgccgcccatgtgcgcaagcaccatcctcgccgctggacggcaccggggaccacaaccgcataacggaagcggtcgacagaacccccacagcctgcaagcaagcgggttctgccgacctccaccaacagcctcgaaaggacgtggctgccatgaagcctacccatcaaccggccaacacacccgttaccgacccgacgatgaccccggccgcgctgctgcgcgccgccgccctctacctccagcagcacggctggacccagcaccagttttacgacctggtcgccatcaccgacgggcagtttccgcccgcctgcgcctccggcgcgatcatgaccgccgccaccggccgctgcctggcctccggcgtgtgcaccctcgacggcgaccccgacaccatcgccgccatccgcgccctgcgcgtcttcgccgcctggctcgacctggaatacaccccgaccggcttctacgagaccagcgccatcgacgtcgtcggcgactggaacgactacgagggccgcacccgcgacgaggtcatcgagaccctcaccgacgccgctgacgactgggatcgtctgcaccacaccgggggtgcccggtgagcctgtcgtacgtcaaccctgccttgacacctaccgccccggccggtgacagccggccttcgaagccgcgccgccgcgacgtcgtcgagaacgacgaatacgccgccttcgtccggcgcatcatccgcgccttcgccaaacgcgtcgccaccggcgacgtcgaagccctgcgcgacatggtcggactctccgcccagctcgacgacgccatcagcgaggccgtcatcggcctgcgcgcctacggctattcctgggccgaaatcggcgaccggctcggcatctcccgccaagccgcccagcaacgctggggaggcgataaatgaccacctccgccctgaccaacgactacctcgaagccctcggcgcccgcaccggcatccgcgtcgagttctacgaccccaccggcagccgctacggcttccccaccttcccctaccggcaggcgcccgagcacctggccacccgacgccagctgcgcgccgacggcctctgccccaacggctacgaccccgtcgcccagatcctgtggatgcaccgcggacaacgccgcgtcgcctacctctaccggcgcgacctcgccaagccgaaacgtgttcccaccgcggcgcagctcgcggtcgtcgccaagatgctgctcgcccgccgcacctgcgactcctgcggcgtcacccgtgactactacatcccgcgccgcaccggtatctgcctgagctgcgaagtaggaggcagccgatgaccacggaccctgaaaacaacagccccgctacgacacggtgccagtgcggcgaccactactgcgcagaagtcatgccgaaagaccaggatcgttcgcagtgctgccagtactgcggctaccgcgactgtgacgtctgcggctggaccgaccaggcgctccggtcaccggaggtctcacgatgagcctcatcgacctgggcaagcacctggccaccgacaactgcctgtggtgcatcggcggcatgagccccgccggtatccacccggacctcggcccggtcctgtgcctctgcccgaccgagcagtggtgcgacgaatgcggcagcacgtcgctgttccccgccgaatacgaaaccctcgacgaccgcatcaacgaactgttcgacgacggcctgtccgccgtctggtgcgaagcctgcatgggcgtcgtcgcggtcatccccgtcaccaacgacggaggcatccgatgaaccctctccgcaggaaggcggcccaacagccgaccaccggcccggccgcccccgcgagcgtcaacctcaccgaacagttcgccatcgagtacgccaagagcgccgtcccgaacatgctcaaggccatcgacagcgtcaaacgctacaaccgagccaccctcatcggcgcactgatcaccagctacctccaccaggcccactacctggccagcaccggcgcgggctacttcgcctacctacccccggcgatcttcgacaccgccatggtctcgatgctgatcgtcgtccgcacccccggcatcgtcaaagacgccaaacgctgggccatggccgtcttcatcggcgcagccctgctctcggccaccgtcaacttcgccgccccggcgacctcggcatgcgcatcgtcttcgccctggtcgtcgtcgtggtcatcggcgtcgaactcgtcgccggacgcatccgccccgacttcaccgccatcgacaaacaagccaccgaactcatgaccgccgtcaacaagatcaaagcccgcggtacggcgaccactccggaaccggagcacaccaccaccggcccgaccgctccggtcgaacagccggccaccccacagaccgcgccggtcgtcccggctcacctgctgcccgccgcccggttctcggtcgtccagcacgagcagaccaccggccagcccatcaccgccgacgacctcgccctgcgactcaacatcaccccggccgtcgccgaaaccctgatcaccaccatccgggacaccaacccggcacgcatcaacgggcacatcccgaccctgaccggcggcgcccgatgaccttcgtccacgtcgacatccaccacatcacccacacctgcccagccaaccctgagctgcacccgttcgacacccgccgcaccatcgtcgccaccgtcgacggcggcccctgccgcaaccccatctccatccgctgcggcgacaagaccgccgttatcgactgcggccgtcacgaaccccaccatcggcaatgcccggcctgccgcatcaccgtcatcgaacggcacatcaccagcaccttcgtcggccaccacggcccgcagctcgccaccaccaggatcgctgcctgacatgagcacgtcgacgctggacctcgcaccccgggagaactctgcccggggtgcgggctcgaacgccgacgcctggacacccccacccgccgactacaccgcagccggccaagccctcacccgcgccacccaacccggctacttcgactggctcgaccacgtccgcgccgccgccgggtgcacccgcccggtccggctcaccggcaccctcgacaccatcgaagccaccaccgggcgcctgctcgactcccggcacaccgaccaacttcccgatgccgctatctacaaggcctgcggtaaccggcgctccaccgtgtgccccgcctgcgcccgcacctaccagcgcgacgcgttccagatcctgcgcgccgggctcatcggcggcaaaggcgtccccaccacggtcgcccggcaccccgccgtgttcgtcaccctcaccgccccctccttcggcgcggtccacacccgccacgtccgcaaacacacctgcacgaatcgcgcccgctgtagctgccgccccgaaccctgccacgcccgccgcaaccccggcctctgccagcactaccaacccgccgtctgctgggcacgccacgaacccggcgacccccagctcggccgtcccctctgcctggactgctacgaccaccagcaccacgtcgtctggaacctgttctccggcgaactctggcaccgcaccaaacaggacgccgaacgccgcctcgccaaactctgcaaagcccgcggcatcccgttccacgaggtcagcaacggcaaaaacctgcgccggatcccaccggtccgcctcgcccacggcaaagccgccgagatgcaacgccgcggcgcggtccacttccacgccctgatccggctcgacggcatcgaccccaccgaccccacccgcgtcgtcgccccaccacccggcatcggcctcaacgacctggtcgacgcactcaccgccgccagcgacatcgacttcaccaccccagaccaccctgaccggccggacggctggccgatggcctggggcgaacagatcgacatccgcccgatcagcctcaccggcaccggcgaagtcaccgacagcatggtcgccggatacctcgccaagtacgccaccaaaagcaccgagatcaccggccacaattcgacgcgcatcaccggcgacaccatcacgcagcacgccgatcccgccggagaccacatcgcccggctcatccacgcctgctggcatctcggcaacgaccccgacgccccagctggcaaaacggcgatccgactccccgtctacaccggcaccgccggtgccaaaatccggcagccctttggagcgccccgccactgtccggactgcggtacccgcacccgctaccggacctgccctgtatgcgtcgccgaacgtcaagccagccttgacacccaacggcccaacgaccgccagcccaccccatacgcccggctccgccgctgggcgcacatgctcggcttcggcggccacttcctcaccaaagcccgccggtactcggtcaccttccgcctgctccgcgagactcgcatcgacttccgccgggctgagcccgatccggccgacaacgccaccgtgcacaccgtcgaccacctcgacgaaaccacgcttatcgtcggcaccctgaccttcgccggagtcggctggcacaccaccggcgacgcactcctcgccaacaccgctgcggctcaggcccgcgagcgacaagccatcggccgagaggaactcgcgcacgaagcgagcacgtcccggcctgtcgccttgaacgccgcctgatcgaagccgcaaaaggaggagtcacccgttggacggcatcaccccgaaggcgctctaccgcatcccggaagccatgcggatgctgagcttgagccgttccgtcatctatgaactgatccgctcggggcggttgcgcaccgtcaaggagggtcgcacccggctggtcccggccagcgccatcaccgcctacgtcaccctgctcgaacaggaaagcaagaaaggagtcgccgcatgaccaaacgccgcagccgtggagacggcgggctgcactgggacgaacagcgccagcgctggatcgcctcggtcaccgtcggatacaccccggccggtaaacgcatcgtccgtaaggcaagcggcaagaccaagaccgaggccaacaatgcactccgtcagaagatccgtgagtaccaggacgggctgtcgatccccacgaccggctacacggtcgccgacgccgtcacggactggctcacctacggacttcccgacgtcgacgaggaaacggtcaacaactacacgctgctggccaacggtcacatcatcccggcgatcggtgcacgcaagctccgtgaccccagcaaacagaaggaactcagcgccaccgacattgacaggtggctggccgacaaagccaagattctcagcacccgcacgctgcgactgctgcactcgatcgcgaatcgcgccatcaaccgagcgatggcccgcgacaaggtcatgcgcaacgtcgtcgcactctgcaaggtaccgaccggcaccgccggacgaccctccaagtcactcacctacgagcaggccaaagcgctcctcgtcgctgccgagtcgagcagcctgcacgcgtatgtagttttgtcgctgctgaccggtgctcgtaccgaggaactgcgagaactcacctggcagcacgtcgacctggtcggacgtccggacgccgagccaccgattccgccggccatccacgtatggcattcggtgcgcgcccacggtgacaccaagaccaagaagtcacggcgttcactcgccctgccggttcgctgtgtccgggtcctcaccgcgcaacgcgcggcgcacggagatccacgaccggatgactacgtctgcgccagcaaggtcggcacccagctcgaccggcacaacgtgctgcgagccttccgcgcgatcgtcgcggctgtccccggaatgaatccggctgaatggacgccccgcgaattacggcacagtttcgtttcgctgctgtccgacaatgggatgagcatcgaggaaatcgccgacctgtgtggtcattccggcacctcgatcaccgagaccgtttaccgccaccaactgcgcccggttctgctgaacggcgcggtggccatggaccggatcttcggtccggatgacactcctggggcttagtcacccagttagttacccagacatgcagagagggcatatccttcgatgagatatgccctctgacctgcctagctagctagtttcgggatggccggctcggtggccgtcgggatgtcgtcgatgtcgggcaggtcgaggcccgtgacagtggccgactctttatcgtcgagcggcacgatcggatcgatctcgtcgatcaggggggtgctcaccttggcggtgaggacttcgcggcgcttgatgtcgaagcgcacgaacgcagaattggtgctaccggccaggtcgaccctgaccgttttggcatggcaggccacggcgatcttgccgacctgctgcgtgaggtaatcgaccgacaggccgggccgcagtaggacccagactcgttcccccaccggggtgggccaggctccgaggatcagcgggaggctaccggagcggttggtgatgatgaactgcgagaagcagacgcgcaggcgatgccgcacggcgacacaccagaagatggcgacggtccagcggcgcaggaccggaacgcaggccgggccgccgaccaggacggcaaggatgaccgcggtcaagatttgtgaggtactggcggccagggcggtccagccccaggccagcaggacggtggctccgatttcgggagtccaccaccagagcattcgcaggaccggccagctacggaccagtgcccagacgagggcgccgcagacagcggcgatcggagccgcgacgaacgcggccagcagcgggtgcatgtggcccttggccacgaccagagcgaccaggccgctcacgatgacggtgaagatgaacgcgaaacgcgcgttctcggcagccgagcgatgtacccgctgctcgatgacggtgacagttccggagcctcgcccagaacggccgggacgggtagatttggacacgacacgtcctcccttgcgggttggatgggttcaggcgtggggccggatggtgtgcgaccgttaccggccccgcgctttcttactggtgatcagcgcccacgcgggacgcgattgtcagcgctgagcgcgctggggcttcggctgcaccgagccgtaccgggagaaggccataaccgtgaggccaggaagaatgcggccagcggcctggttgatgaggtctttggtctcgaggagatcaccctgttcggtgatcggatttttcgagtggatgtcgatggagccgtagcccccttggaacatgtaggacacgtagtaacggaacatgatgggttcctttcaaaaaaatgatgatggccgcatattgcggccggaggccggaacgaaatcgctccggccatccgatgaatgagcagggattacggcagcaaaaggccgcctgggatcagatgccacggacactgtggcggcagtacggatggggttgcgaagggcctacttcgccgaggcaccggagagcggcttcagcgacaccgcacggaacgcgacgccgttacgcccgttggtcgcccacggaatggcctcgagctgctcgatggcgacgagctgtcccaccgtcacgttcggcttttcgccagccgtcgtgatggcgatgacctcgccgccggtctcgtcgagcacgatgacctgggtggaccacatgggccggccagtgttcttctcggaacgctggttgccgttctggtcgttcttcggctcggtcggcttcgacaccgtcacctgcttgccggtcgtgtccacgtacagcttcacgaagatctccttcgttccagggatccaactggaatcccgaacctttttgttgagccgatcggctccgccctccatgaaacgcggaaaattggccccgcagcaggtctccagatttgatccgcggagggcatcactggctggcagtgactaggactgactcgggccttgcgaatgacacgtcgatagggcagtgtgaatgcggcgcattatcgactctcacagggcggaggctagagatgacgccgctgcggctggaaaggcagaagctcggctggtcgagaacccgccttgctcacgaactggagcgacgggcgcagggaagattcagcctggccaccagagcgagtcttctgcggatgatctcagcgtgggaaagcggcgcgcgagacacctcggacccgtatcgcactctgctgtgcgaggcgtatggccggaccgctgacgagttgggcctgggtggtggcaccgaccgagcagaatcgagcgtcggcctgtcctacgcttcatcgcttgacgcggcagccgcaatactttctgaccttgcccggttcgatgacatgaagcaccctgcggtgagccagggccgctaccagcccgatgcgttgaacgcggtatgtctggactggctgttcggcacagcctcgaatgacatgccagcaggcgctggaaaacgcgtcaccatgaaggacgtcgaggagatccgcgccaccacgtcgatgttcgacagcctggatcgccgattcggaggggagaacgcccgcagtatggccgtgcgttttctgcgcgaggcggtgctgccgagattcggcaagacatccgaccagaccgtaactactgagctttacagagcagcagcgatcctctgcgagctgatcgggtggatgtcgttcgacacctcacgcaactcgttggcacagcggtatttcacccaagcgctgcgattggccgaggcagctggtgaccgcgcctatgcctcgtacatcttggcgagcatggcggaccaagcgctcttcctgaagaggcctgaccaggcgctacgacttgcacaggtcgctcgcgatgcgggggaaaaggccggcgttgcggtggccacaaccgaggcgagcatgctggaggctcgcgcattcgcagcccagggtgacgagagcggctgcaccagggcgttgcttcgcgcggaagccgccttcaacagcatcagcgcagacgacaacccgagttgggcgaaccactggggtgacatcttgtttgccagtcacgctggcacctgttgggtcgatcttggtgcgccgaaggaggcagcgagcttggttcggacagtctgggacagcgcgaaggatcaggcccgtcgtcgggtctacagcggcgttcagctcgctcgcgtggcgctgcttacgaacgaggtggaacaagcggtgtcgtatgggatcgccgcccttgaggcgacgagcggcttgacttcgaatcgctcgttgcagcagcttcgcgacctgcgtgatcagcttggaaaccatgccaagcatcctgctgttgtggagttcgaggagcgcgctcgattggtgctggccgcttgagtaccgtaagcctcgtgacgttggccgaggacctggaccgcgaaggtgaacccgagcgggagttcaaccccgggatcgcgcagcgactacctaggaagcgggttgctggcggagcgctgatccgcgactcggctgatcgaatcctgttcgtcgtgccgaactacaagcccctgctggacatccccggcggcattgccgagggcaacgaatctccgctcgcagcgtgccgacgtgagatcaaggaggagatcggcctagacctgccgatcggccgacttctcgtggtcgactggatcccgcagcacggcgtgtggccggacggcgtgatgttcatcttcgacggcggccggctaaccgacgacgagtcccgcgacctgaagcacaccgatgatgagctggtaggactgaagttccttgccctcgatgatgcacgccatcagcttcggccctcaatggttcgcaggctcgaagcagggatagaggccttgtccgatggagagccgcggtatctggagttcggtcggactcagtaaagcggatggccttaccggcgttccatccgttcggatgttcgggcgatggctgcattgagatcatcggcagcctcggtgatgaacgctgtcacgagatggcccggcccgtaacgttccttgatctcggctacccgctcctcgaaggtcgttcgttccccgtcgggtgtcgtggtgagatcgcagaaccagagggcgtcccggaccggcgacgcctcgtcatggaaagctgcaagttcctccgcaaggcctcgcatcttggcttcgcgtatcgcacacgaatggtgcgctacaaggtgaacaagccgttccggagcactgacggaccgaaggaagtacgccccgtctagcggatggaaacccgtctgcacgagatctggcgcatacccgatgtcgtggagtacagcagcagcctcaagcaagcgggcatcgtcgccggcggcgttaccaacagtacgagccttcgccgcgacaccttgaacgtgagaccagcgacgtggcagcacatccgcgaggacgcgttcagacgtttggtatgcccaagcgaccatcgacatggacccaacgatatcggtgaactcgcagattcgtatgcgttgacggagccggtcggctgccggatcttgttcaaactttctgtacgtcttcaaggcggcccgaaacgggccgctcacgccgccgcctgggcgcgtgccggtcgcttagctggcgcacacgaccggcacgccggcagcccgtcggctggcgtgcaggagcggatcgggccgcggcgacgacagtccaacaggcgggttgaggctggggagtttggccgctgccgaccggtgcggccagggcgacgcggccgagctgccgcgcgcggccgcagcgcgagtcacggccgtcggccgccgggcgcggcggcgcgcagtgtgtccgggccgctcctccgaggtcaagggcgcttcgcgtcgcaagcgacggccgcaagcggccgccctggacctcggagcctctgcggccctagcggccaagtggtcaagcggcaggccgatggcctgcccgcaggtggacgcgcgccaccgcacccggtccacccgactctgcaagaaccgttcgctacttcagcgtcaatgaggaattgacaccttggacgtctttggcggccaattcgcaaaggcgcttgtgggcctctccgaaagcgtcgattctgtattgtcgatcatcgcgcagcttgatgaattgttcctcgtgctttggattatctggccccacttgcggtgcagcgcaaaaggtttgatattccttatgcgctatggccgcctgctcgaacgcccatcgccattcactcatgcacttcctaaattcggcagtgctgaatatcgaggcaagtgcgtccatgcgagcctgctccttggcgtcgctcaaatcgtttttgtactcttcatctgcaataatgcatcggcgtaattggtcgcgagtaagtgcaaaccacgttaccaactccaagtaagctgactttcgatcggcgtgcgcggcgatctctctctggtaaacccgttcgctctgcttgctaaaattccccagaaagaattgaaacccggcccccgctatcgcaaaaaatccggttatcacagcgggccagaagggtgtcatccgcattcctcatctctggatcaggctgacacgggcttccatggtctccgtgtgcgtcaagccctacggtccagtaggactgcgaacaggtgagttctcgccgcacggggacgcctcgccgcctgcgccttaagaccctactgtggtggacatgacgcgcaacatcgatgcagtgcttcgggtctcgcctgcagacggacggtggtatgtggacatccctgagttcaacctgagagtggatcttccggcgtcaaggcaaagtagcgacctgcgtaaccggctaaacgacgccgtggcaccgcacgtgcctgcggggaccgacttcgtgatcaagatggcacctgagtgagtggcgcgccttcctgagtgactaactgggtgacaatcgccaacgatcatggcggacaagcgtggacgctgatggacgtggacccgcaggtgagcagtgtgttgaccaagttcattcaagatcatgagttgctagctagctagcagcttttgaaggccgttggcaaggacgaaagtcctggtcagcggcttttttcatgcatagacatcgctcgcccaagatcgctttagtggatcttgtggtcacgggcgtggtcacggaagtggctagcgtggatctcacctgctcgaacgtgtgaccacggggagacctgatgactgtcggctcgtacgaactctccaacggcaagaccaactggtacttcgtcatcgacctcccgatgggagacgacggaaaacgacgccagcacaagcgccgcggattcccgaccaagggcagtgcgaagaaagcggaaaccgaagcgcggaaagcgtacggggacgcgagcatcgccgctgatggaagcgtcgcggcggagctggacggctggttgtcggagcgtgaactcgatatcgaagagaccacgctggacagctacaagaacatcattcggatgtacgtggtcccgcacatcgggggccggcagctctacagcctcgacaagcgggtcgtgcaggacatgtacaagacgctgttgcgggagggcggcaaggacaagaagccgttgtcgccgacgacggtgcgcaccacgcaccgggtgttgcagcaggcgttcaaggatttggggatcaatctggagaacgtgcggcagccgcggccggccgaacgtgaggatcacggccgtaagggggtgtggtcgccgcagcagtcgaagacgttcctgcggcatcaccgcgatgctcgactgtatgcggcgtgggcgttggcgatcgtcgcgggtatgcgccgtggggagctggcggggctgcgctgggcgaagatcgatctagatcaggggatcgtgtacgtgcatatccagcggacgatttgcgggaacaaggtgatcgagaaatcgccgaagggcaagagtcgccggccggtagcgatcggcccggcgatggtgagggtgctgcgtgagcacaaggtccggcaggacgctgagaaagcggaggccgggctgttgtatcacgaccgggactacgtgttcccgcgtgaggatggggagccgtactacccgcggtacttcaccgacatgtgggagaaagcttgcctggaggcgggggtgaggcagatcgtgctgcacgacgcccggcacacgtccgcgacggcgggtgcggacgctggtgtcccggagcatgtgatgcagaagcggctcggtcatgcggatgggcggaccacgcgggaggtgtacacgcatgtgttgccggagagcgagcgtaaggcggctgagttgatggactcggcgttgcaggactgggacgaggcggcctgaccggttcggtgccggctggcggtgtttgcgggggacgggcgttcacgcccgccccgcggtcttgcggtggtggttagtcgtcgtggcgttcgtcgacgacgtacggggtgccggcgagcgaattgccgatgggggttttggcccaggtggtcagcaagctggggtggtcggtgcagaggttgagcagggcgacgatctggtcgacggctggtggagtgtcgagatggcagtcgaggatgttttcgctggtggcggatccgtcgtcctcggagtcgtcgtagtccgggatccactgctgtagttccagagtccagaggctgctgtggcttttgtcggggtggggtgctgacagctcgacgaagtaccgctcgggattgttgtcggcggggtcctcggtgatggacaggtactcggcctcgaagcggcaggtgttgctgggatggcgccatcgggcttccgcgaggagtcgcaagtttttgatgccgaggcgaagctattctgctcgcggagacactcaaccgccagcacgatcacgccgaggcgctacaccaagcggttgacgccgatgccgccagcagcagccggccggccaaccggggtcgcgctgtcatcatcgccggcgtcatcgcggacatcaccgtctgcctgggcctgcccgacgccgccgaagcgtgccgccgctaccgtcgtcaggccgccgagcacaacggcgatccgaaccggctcgccgtggcgaacgcgctcaccgtgatcgccgagcaccgcggcgaagcgtggaatgaactcgcccgcatccgcgacagctaccaccggcgaattagcccttggctgactctgatgctgcaccgagcggtcaccgcgacaccaacggagacgctacgccatccgacctcaccgcgtcttcttcccgtcctgcccggcgccatcctgagccctgacccgggcatgccggaccccgattacctcacccaccgcatcgcccgactcggcaccggcgggactacccagccgtgcccaccgaaaggatcgacatggacaacgcactggtgagcggcggcccggcgtggcaacgcagcagccgctgcgcgaccagcacctgcgtcgaagtcgccgccgtcgacgaccaaatcttgatccgcgactcgaagaaccccgacgccgacgcactgcaggtaagccgcgcggatttcgccggcttcctcgccgccgtccgggccggtgacttcgacgagggtcaggctttcacctgaagcacgcggattccacacctgcggccgccgggccacgccggcgaccgtccaaggttttgcctgccaacggcgtcaggcaagaccgggtgatggtcgcagtacccagcagtgccttcacccgggccgggtgcgtacgcacccgcgcgtgtgcacccggcacccgcctcgccgcctgtgaccaaaccgcggcaccccatgaacgtgttcagcgatggaggtcaaaccatgcccgcccgtcgcatcggccgtactccgacagcatcactcgtgaccgggaccgcggtgcgggcaggtcatcgccacgccagagtgtgacccgcaccgcgacctgccgacaccggccggtgatcgccgatcgagcgcccagaccgcagccggatcccggcgagggaaccgaccgtgagcaggcggcggccacgacagcagccgcgccaccggccaccagtcacgcaccggccctacgtggggtccggcgtagcctgcgagcaggactttcggcaggcgctgcgccaatatctcgatcaggtggaaccgaattcggtgggcgtcgacgccggtgctgggcactggtgtactgcaaccgcgatcggagtgaaaagcgccgtcgctacggcccaagccgcttgcggcctggaggctgaccgcctgtgctggccgcggcaggcaggtgattgctccgcgctccgggtcctgacagcggctcgcgagcagatgagtggcgaacgcacccgcgcggtcaacgcgctgaccgcgctgctgcgcagggccatctcggtgttggcgcccgccgagcctcgaccaccacgagcgtcgcagcctggcgcacccgcagcaacggcatcacgctggccacctgccgcgccgaggccatccggctagtccagctgggggaactggacctcatcggctgcaagccgtccgcggtgcccgcgccgactactccgccgcgcacatcctctgggcattcgtcctggtcatgagccggcgcctaactcgcttacggcgccggccgacagcctgacgatcgcgtcaggccaagttctcggctagtccgaacatctcctgcctgatgctgctctacgcccagcccgccagccgcatcgtccgtctcaccagcgacgacatccttcgcgacggcgatcaagtcctcatccgcctgggcacaccgccctcaccagtccctgaggcactcgccggcatcctgctccagctcgtcgacggccaaccggacccgacgagcgccgccaaccccggcaaccgctggctgttccccggctacagggccggccagccactgcatccgagaaccctgctgctactcatccaccagcccggcatccccgccaaagccacccgcgtggccgcattacgccaactcgtcctgcaagcccggcaccagtcatcgccgacgccctcggctaccacaacaaacacgtcgccaaggtctggaccaaaacaggtggcacctggaagacctacgtccccggcgaccacagcaaatgaccatccgatggggcgttcctgtcctcatatacgcagttgtttatgaaaaccgttttcatatacgttggggctggttggccagcaaggctgattcactcgcgggaggaagccgcatgatccatttccttcatcactacacggagatcatgactgatcctgcgcactttgccgccgagatcacgatgatgctcttagtcgatgtgctcttcctcggactgatctggccactgctacgtcgagccatcgacaggcgggtacagaaccggcaccgcgccatcgaggacgccgacacccaccagcctcgataagccacaggccactgcagcacaacgagttccggcgctctcaacccagcaagcatggatgctcggctcaggtcgcggctggtgacacagggttctgctgcaccgataggtgacaggtcaagtcacgcggcctgactggccgcggcccggcgcaggacctcgttctcctgctcgaggagcttgatccgcttgcgggcctcgcgcagctcggcggaatcattgcgactcacgccgggctcggcgccggcgtcgagttcggcttggcgcagccacttgaacaacgtcatcgggtggaccccgaagttcttggcgattcgctcgaccgtcacgcccgggtcacggccttgggtgatccgcacgacgtcatcgcgaaactcccgggggtagggcttgggcacagcaacatccttccagcccgccgtcacggcaagccatctcagatgattctggcggcctgcggtggccccacccggaccggcttaggttctaacggtcgtcgcaacacctgacccgttcaggagttgccgtgtccaagcctcgttgtccgcgcaagccacccggtgccggcccggagcaagcgaaacgtgatcactaccttcgcctcatggcgcagggcatgaacaactcggcggcctgcagggaagtcgggatcaaccgtcgcaccggcacccgctggcgatacggccggaccatcatcagcgcggacggcgagtccagggtctatgcgccgatcgctgtgccgaagcgggctgtttcggcccgctacctgtccgagtccgagcgcatcaccatcgctgacgagcaccgagccggcagctcgattcgggcgatcgccgcactgctggaccgagcgccgtccaccatcagccgagagatcagccgtaacagcgacccggcaaccggcgactaccaccccttcgccgcccaccagcaggcggcggcacgtcgcccacgacccaaaccagcgaagctacaaaccaacaccgagctgcgcgacctggtccaagagttgctaaatcaacggtggagcccggagcaaatctgccgtgccctgccgctgcaacatcccgaccggccagaactgcggctaacacacgaaacgatctatcaggcgttgtaccggcccgatcgaggcggcctgacacgcagtcgctcgccgctgctgcgcaccggccgcacgtatcgcaagcgccgtcgcagccgcgagcaacgcactccgcggttcaccgacagctcgaacagcatccacgaccgtcccattaccgccgacgaccgcggcatacctggacactgggaaggcgacctaatcatgggcgcccacaaccggacggccatcggcaccctggtcgagcgcagcacccgctacgtcatgctcgtccatgtcccgcaaggtcgcaacgccgcacactttcgcgaccagctcatcaccgcgttctcgaccctgccgacggagctaaggcagtcgttggcctgggatcagggcgtcgagatgggccggcatgccgagttcaccgccgccaccagcacaccggtctacttctgcgacccggccagcccctggcagcgcggctcgaacgagaacaccaacggcctgctccgccaatacttccccaagagcagcgacctcagcgtgcacaccgccgaagacctgaccgccgtagccgccgaactcaacaaccggccgcgcaagaccctcggctgggacacccctgccctgcggttcgcccggttactcgccgaagccgcatgatcacgtttactgatctgccgagaaccgtgcactcgacaacgcatcgcggcactgcaactatggagcctgtgccaggtcgaccaccaccaaagccgtacgacttcgccggtccgagagcacgctacttcaaagcactgatccaaatggtaatcgggatagtcgccgttctcggcattggcgtatggctagtcgtcaaactgtttgaacgcccgttcccggcagtgcacgatctcagtgacgggattttcggcggcatcggcttcgccctcggattggcagccgtggtggagctcgcctacaccttgttcaccgatggccccgatgaggcgctgaacccggtgatgctgggtgttgcggctgcactgttaatccaacttggcagggtcgagactttcaaactcggcgaggcgctggccggactgctatacgcggccgcgttggccggtctatttgcgactaggcgttggctggccgagccggaggacgaacagagctggagcccgccggcaggctgggcaaaacgatggcgtcgtggctctaccaagtggcatgtacgttaggccgttgctgctcgtcggacccgccacggcgtaacagttcagatgcgcggatttgccgccatccgcgcgccggcaagccgtggcgggcgtcgctactggcgtcgctgatgtactcgctaggctcgacgtcgtagtcgttcaccagcaatgttgcgacgaccgcctgaatccgccccgtccgggtggggccaccgatacccgtcagaatcacatctcagatgtcacctattggtgcagcagacccgctccccctgaacgaggccacgccctgcggcgccggttggttgtgagtggggtcgttatgcctcggccgactggtagtgcaaatcggtaaggcgcggcaggcgttgacgcatctcagcctcgtcgtcgaagtcccaggtgaagtcgagttccgggtaccggatggtgaaggcatcatgtggcagctcatggccggtcgctgccaggtacgcgttcgaggcaacgttgaggacatctccatcctccaaacactcgccggctgcagcggattggatgacgatggggttgtcggcgagagtgtccggatcggcgactgcttgctggaacaccgtgcgtccctgagtgatcagccagccgcggaagtagtcgaaaccgtcatcagaggcaccgccgttgactacgtaggcggccgcccaaagctcgacccggtacgactcggcgagcagatcccacaagggctgagcgaaggaggcaatctcagctggctcacgttctgccagcaactcgaccatgcgttgtgcaacctcgtctgcctgcagtgagccgtcccgctcccgtcgagcctgttcaaccagttgccacacatcatcggtgtccacgatcagggagtgtcgcacgctccgcagcagcgccccgctggacgtggtcgacaacgcgtcgcgacaaccaacctgcggcgttgatcgacaaggtcggatgcaatgatctccgcaggtccatgtacgctgcctcggccgagatgcatacagaccagtgcccgctcccgccgatacctttgccaccgaacaccgcgatgatcgacttcgccggtcagggcggtcgtgcaggtgactccgttaggttggggctggccgggagttcggcgtcgaggtagacggtgacgccgtcgccgttacgccgcgaccgctgtcggctctggcgggtgacggtgaggacctcgccctggtagcggtcggtgcggtcccggatgtcgtcgtcgatgatcggggacagttaggcctcccacgcgatacgctggctgccgtcgtgggtgtcgatttctgaggtgctgtgcacggctgtccgcggtcctctgcacggggtgaagatcagaggcattcgaatattgacggcgtcacacctggtccgcactggtcacggccagcagccactgcggttcgtgtttcggggtcaggccgagcacccgtagtactacgccgagcttctcgtccagatcgtgctgttccctgattgcgacgagctcgccgaggttcaccggccgggttgcacctgaccgaccctgcaccgtgtacgcggcgagcagacacgatcgggtagaaccgcggcggagtgcccagccatcctcgacgaaggtgacgccgtagcgatcgcggacggcatgcccctgctggtgccagtcggtcacggtagggtcggcgtcggggatcgtcatgtacaaccggccgacgaagtcggctgcgccggccggggcggggacaccgtccggggtgccgctcagccacggcagatcgagcaggccgttcccgtcgacttcctcgaacgtcaggtgggggaccggatggatctggtacccgaacatcagcgcagcgtcgtaccgcatggtcatcgtggtctcctcccttcttcaccgatcatggcgggcacggtgcccggccggatctgttccgggcgatcctcgccgccacggaccgcccgctaccgggcagtcatatagggctacacagcgcctcgttcccgcccgacaacccgcccggagccgctcctgcgcccggcagccggcccgagtgaccgccgctggcaccggagtggcgccacgccaaagggggcaacaggatcctcatgggatgggcttcgcggaggccagcggccgctcactatggccggcatggaccggtaacaggctcacctcggtcgccacggacgcgcccgccgcgggcgcttccgcaccgacctggacctacacctacgacggcagcaagctgacccgggtctgcagcccgctgtcggccacctcatgcaccagctacacatacgtttcctcctcgcactaccgctcagtggtgctcgacgacaacccggcagcgtactggccgctcggcagcaccgcagccagcctcgagaacgtcgtagcgcgcagccccgacgagaacaaggccaccgcccgcaacgttgtagccaaccggcccggcgcattggccggctcgccggacggggcactcggcttcaccggcgccgctgacagctatgtgacgctgccggaggcactgctggctccgtccgtggcgttcagcatcgagctgtggttcaaggccgccgccggcaagtccggggttctcttcgggtcccaggcgatgcagattcccgccgtctcagccggtgggtgggcgcccaacttgacagtcggtatcgacggcaagctgcacggctaccagtggactgccggcggttcagcctccagcccgatggtttcgcccggtgtggttaccgacgggcagtggcaccacgcggtgctcaccatggccgttgacaagcagagcctctatctcgacagcgcgaaaatcggtgagatctccggcaaggtcgtcgaccacatcgggatgacccggcactacttgggcaacggatacaccaaggactggccgtcgatgggggccggatacttcccgttcaccggtgagatcgatgaggtcgccgtctaccggcatccactttcagccgcccaggtcagcgcgcattacagcgcgcaggcggccacctcacggttggccacggtggtcgaaccggggcagttcaccgccacgtccgcgacctacgaccacgcgtccggccggatcaccactatgaccgaccgcaacggcgcccagtggaccctggcgccgccaacagtcggcaaccgggttcgcgtcgtcaccttgtcatcgacggcccacgacgccatcacttatacctacgacgccgaccacaacggccgactggtcctgcgtaccgacagtgccggcagcggcgactgggaatacgatgccgccgggttcgtcaacaactacaccaaccccaacaaccgcacccgctacttctattacgaccagcggggtaaccggaccattgacgtcgacaggtacaacggcacctggcgataccgctactacggctacgacctctacaacgatccgctcgacccccgcaacgaccagctgcaatggtcgaccgacggccgcagcgacggaatgtcctacgagcaccgcacctggtactaccgcgacgagaaaggccggccaaccgcggtcgtcaaacctagactgcccgggcaatccagcccgaccgcacgcaaagacttcacctacaccaccggcaccgaggacgcgatcggcggcggcaccacaccccctggcctgatgtccaccgagtcgaacttcgccggcggcatcacccactactactacaaccgcgcaggcgaccgagtacgcaccgtcgacccggtcgggctgaccaccgaggtgagctacgacgcgatcggccgcccgaccacctccaaaatcagcgccgtcgtgaacgacgccacggtcgactacggcaccaccacgaccacctacaacacggcatcgctgccagacaccgtaacgtcgccggcaatcgtcaacccgatcaccggcatcacccacaccgcacgcacgaaatacacctacgacgccgccggccacaccacgcaggtcgacaacagcgacaccacaggcggcgacgccacccgcacctggaaaaccgggtacgacccggccggccgggtcacctcctccaccaccccggacggcgccgttgtcaccaccgagtgggatcaggccggcaaccaagtccgcgaaaagcggcccggcgggcagatcctggaatacaagtacgacgacctcggccacctgaccgagacggccaccaccggcgacggcgttgaccccatggacccagccacgacccggatggtcgtggagtcgcgcgcatacgaccctgccggccagctcgcctcggtggtcgacgcgatgggacgcgaaacggcgtacacctactgggaaaacggcttcctggaaagcatcaggcagatcaaacgcgacgccgacggcacgatcgcgtccacggttttgcagcaatataacaactacgacggcgccggcaacgtggtgcgccgcaccgaggccggcggcgtcgtgcacgactacctgtacgacaacgccaacaacctcatccaggacgtcctcgacccggccgggctgatgcgctccatctcctaccggatgcgcggcgacggccagccggaatcagtggtctccggcaacggtttggcactgggcgtcaacacccccggtgaatccgccgtactgtccaacagcgggtccctggtcgacgggtcgcaggcccgctacgccgacggcaccacgtccttcacctacaagttcaccctgcccgccgacaccaccggcgccagcgtgaacatcgatatcgacaaccaattcctcgtcgagaccagctcggacaacagcacgtggaccaagatcttggaggagacgcgcgacattcgcgacggctccaaccgcgcggtccgcaccctcgacctaactccggctctcggggccggcaagacggtctacctgcgggtgcgtgacagccagccagccaacggctggggcggccgtgtcgtgcgctcggacctgcgttttcagcgtgccggcgcgcccccggaggcggcaagtttcggctacgacgcgatgggccgtgccaccagcaccacgatgaccgatcctacggacagcccacaggcgctgatcacggcgaccaagcgtgacccgcgcggcctgccggtctcggtcaccgacccggccggcgcggtcaccagctacacctacgacaacgccggtcggcaggaaaggatcgtcgagcccgccaggtcggtatggcgcaacggcgtcgccaccgacaacgtcaccccgacctcggtggccggccgcaacacgttcggcgaactgaccgagtcacgcgacgccaacggcgcagtcgcacgaatcgtgcgggacggagcgggccgccaagtcgagcaaatcctgcccgcctacaccccgcccggcagcaccgcgatcacgccgagcaccaagaccgcatacgacgatcgcgggctcgcggtgaccgagaccgacggcctgggccgggttaccagctacgagcacgacaaaacggctggctgaccagcgtcaccggacccgaccccgacggcgacgggcccaagaccaaacccgtaacccgttacacccacgaccgggtcggcgagatcctcgagacgaccgacccgctcggcgcccggcgcctggccacctacgacgagcgtggcaaccaggtcaccgacaccgtgaccgaacgggccggcggcaccacctactactacacgaccaccatgaccccggacgaccgcggccggaccaccgcgatcaccacaccgctcaaccacacgaccaagaccagttacaacaccgccgacgagcggacaacaaccaccgacgccgacggtgtactcaccgagttccgctacgacgcgtccggccgcaccatcgcgcagatcgtcggcacgatggcaaccggctggacctacgacgcgctaggccgcaccatcgcggtcaccggacacaccgtcaccaatggcgtgctgtccgcgccgctgcgtaccagccgaaccagctacgaccgagacagccgggtaacgcgcaagacctccgccgagggccggatcaccgactacggctacgacggcggcggcaacgtacgcaccatcacccagctgcgcacacccaccgaccctgcctccgcagtcacggtcgggctcgactacgacgcactcggcaaccgcacccgtaccagcgacggcaaccagcatgtcaccgaataccgctacaacgactggggcgcgcccgtcgaagcggtggaaccagccaccgccgcgcacccggcagccatggaccgcacctggaccttcatctacgaccagggtgcccaagcgatccgtgccaacctgcccggcggcgtgtccgtcgaacgcgactatgacgggctcggccagatcaccacggaacgcggcagcggcgccgagggcgccagcaccacccgatccttcgactacgacgcgctgggacaactccgcaaggccagcaccaccggcggcgacaacacctacagctggaacgaccgcggcctgcttaccgacgtcgccgggcccggtggcaccgctacctacacctacgacgccgaaggccggctttccaaccgcagcgacggggccggcccagccgcgttcacctacaccagcgccgggcggctcaaaacggtcaccgacccgctgatcgcaaaaacgctcacctacacctatcgccccaccggtgaggtgcaaacagtcagccaaggcaccggatcgctgtcacgcacctacggctacgacaacctgggccggctggccagcgacaccctcaccaaagccaacggcacccagtccgccaagctcgcctacacctacgacagagacgacctgctgaccggtaaagcgtcaccggaatcgccggcgacggcgccaacgcttacggctacgacggcctcagccggcaaacctcatggacacgacccgacaattcgaccgtcgcgtacggctacgacaacgcttcaaaccgcaccacggtcagcgccggcaccgacacccgcacctacgcattcgacgagcgcaaccggctgctcaccgcgaccggcggcacacaacccagcttggctaacacctggtcaccgcgcggcaccatccgcagcaccaccgaaaacagcgccaccaccacctacacgttcgacgccttcgaacagatgaccacggccgccgaccccggatacacagtcacctacgcctacgacgcacaaggacgggtggccacccgcaacggcatcgcctttggatacggcggaatcgacaactcgccagtactcgtacccggagccgggcacaccccccgagggcagatcttccgcgatcccgactcgcgaccgctgtcagcgaccctggacggcagccccggccgcgggctattcgccgatgcccgccacggcgacatacgcggctcgtacgacccggccgacggcagcctgaaccgatccgccgtctacgacccgtccggtgaagtagttgcctcgaccgcagacaaactgcccttgggcttccagggcggctggtctgaccaggacaccacactgctcaacaccgacagccgctggtacaaccccgaatcggccggattcaactcccgcgacacctacacccttaagcccgatccggcggcacaagccaaccagtacggctacggcaacgccagcccgctaaacaacatcgacgccgacgggcacaacccgctcgtggcgctcggcggcgtattcctgggctccaacccggtcggctgggccatcctcgggatagtcgcggttgccggcaccggatacctggcttaccagggctaccaatcgtacgagtacagccacaacgtcgccaacagcgccagcagctggggcggcatggccacgcagaccagttcgtacgcgtaccagcaaaacgcgtacgcagctcacctcagcgcggcagcggcgcagggtcaggcccaggccacctaccagctcgcgatcgcgcaggcggccgccaacgcgcacgtggctgcaatgaccgccgcgtacaacgcctacgtcgcgcagcggatcgccgcagcgcaagccgcagccgccagactgaaagccgagaccgacgccgctgtgaaactcggccaacagcgtctcgccgcggacgcagcccagcacgcggcggccgtcaaggcagcccaaccgggaccagtcggtaccacggtggtcaagccaccagcggcgatcgctctagtcggtggcgccggcctggtcaccaacattgacgcgacgaagcagctgcccgggacggtgtttgctggcgcgggtggcaacgacgcaccgaacatcgcggccgcagcgggcgcagtggccgccaccgaagggctgcagattgccggcggtgataacggggacgacgacggctgtggccagaaggcagccgaggatctcgcggaggggttggccgactgggttgatcccaacgacatcaacttttcgcagcggacagtctcgccaaacgactacgtgcaatcgatgaaggacggcacctgggactggaacagggagggcaccgcgctgcgtgtgcttgagcgtgacggccagttggtcagctatgacaaccgccgcttggacgccgctcgcgaggtgcgtgccgaagacccgacgtaccgagtaaagatcgaagttcttgaccccgaggcggctaacccagccaaaagcaccggcatgaattgggataaaagcttcgagaagcgtatgacgagcaagcggaacaaggacgagaatggctgccgggtaccgtggcagggcttgcatgagcggccgaaatgggagtgaggcgtacgggcatgattgccgacatgtggcaacagggagaggtgccggcgttttccggtctataccgggcggatggcactgcccgcgccatcgaggttgacggtgcggctttgagccggttcgaggttggcgagccgttcaacccggccgagcgactcgccgttgacccagacgcggtggctgaggtagacgagtcggcgcgtaccgcagtcccggacggctacataatcagtggtgaaggtgctcacggatcggaaggattcttcgcccggctggatgccgcgggccaactggtctgggtgctcttcctgcggaacgggaatccgttctacgagatagtggctgacggttcgcgggcgacgttcataaacaacctgggtaatgccatcaccatcgatctgaccgaccctctgtacgcgtaatggaaaagatcatcgtcaatcacaagcacgtggcgggcgccgactactcagggcaatccatcgggcagttcagcgcccaaggttctaccttcgaggactgccggttcgaccgcagcatgctcgggcaggcgtccttcggatcggggacggagcagtcttactacgtccgctgttccttcgatagaacctctttgacttttctcggcgggttcgcccggtttgttggtcgcacgtttacaacacccgctttaaagctcctaacacgatctgctgaatcgatgtttgtcagcgttgcggggtgaagatcagtctcgttcggtcgtcgtgagcaaggcgtgggtaatcgatgacgagttgtgggagttgatcgagccggtactgccgccgtggccggcgaaggctccggggccgcggccggtcccggaccggctgtgtctgcagggcattctgtttgtgctgcataccggcatcggctgggaggatctgccgcaggagctcggcttcggctccgggatgacctgctggcgccggctgcagtgctggaccgaagccggcgtgttcgaccaagtgcatcagatactgctggccaggttgaacgcggcgaatcggatcgactggtcgagagcggcgatggacggcagtcacatcgacgcgaaaaagggggtgccgggacaggcccgtcgccggtcaaccgcggcaaacccggctcgaagcaccacctgatctgcgacggcaacggcactccgatctacgtgctgaccagcggtgcgaacgtgcctgacatcaaacgggccctcgatctgctcgactgctacccgccgatcgccggtcggcccggccggccgcggcgacgcttcggcgccttgctggccgacaaggcctacagcagtgcagcgttccgtcaggcctgccgcgagcgcggcaccgaaccgatcatcccgaagcccaagaccaccgggatcaagggcctgggaaagctgcgttacgtcgtcgaacagaccttcgccctgctgcaccagttccgccggctcgcggtgcggtgggaacgccgactcgacatccacgacggcctggtcagcctcgcctgtgtcctgatctgctggcgccgagtgattaactggacccgctaaaagatcgtgttaggagcttttacagtcgattgtgatgaacctaatcggcgagttggcaaagtagcgagtattggttgagcgtgcccgcccgacttcccgcccgactgcccgccggcccgatagcgcggcggcgaccaccgtcaccgcggcaaggggcgcgcgagcatgacgccccgcgccctgcggattccgacgggcaaggattggcggccacgacggccgcccgtaacgtcccggctcgcacgcgtcgctgtcggtactggaaggatcgcgtatttgactgttgcaagttcgtcgcgaccgcccgctttcgcgtcacgcagcgttatgcaagctggcctgcgggcgatatggcatacggcgcgcagaggatcagcagacgctcgccaccgtcgaagccgaactccgggccgaaaagctaacagcaacgctggtcagagtcgcgcgccgagcggtgtgtcgctcgggctatcaagcgattgaccagcgttgctgttgactctaaacaggaaactacgtggcagccttcctggttacacccggcactgccaggagtacgggtcgtagaagttggtgaagcggtcgacggcgctgttgcgcatcttggtctgctggcaggcctggagcacgttcacgggggagtagaccggcccgttggggctttgcgactcgcacttccagtcgtagacggtattgccggtcagcaccgcacggtcgcccgtcgggtgatgcgagcagtagccgtcgagagccggcgcggtgacctcatccgtgctggccttccagcactgcaccgacgccggggcgtagaagttgtcgatccggtcgaagacgaaggccgcggaaccgggcaattcaccggggtaggtccactggcatgccttcgtgaacgacaggtccgtgttctggccatcccgggtgcggcagtgccagtcgtaagcggtgccgccggacagcacggcgtccacgttgccttgtgagcggcagtagccgcccaggtccacggcgcctagctcggtggcgccgattggtgaggcgctggctgcggtcggcgacgtcatgagcgtcgcgacggcgccgagaagcaccatcagggtcgcgaggattcctcggaccgcgctgcgggtcattcgggacatggttctgtgtctctctttcttcggggtgagcgtccgggttcggcgctggagcggagggcgtcgttgccgcatttgtcgtgcctgactggacctcctatggggtggaccggtcgcgccggcgaggtctacatcgatcccgcgtggaggggcactgaccactttgggcgttcaggatgatctttgcaagtccagagcaaaactttcagtcgacgtcacactaactaccgtcgaagcgccgatccatagatgggtggcgtgcgacgcggtacgcgcgcggccggacgtcctagggtcccctcctcggctttctgctgttcagccgctaggcgttcgtggcgtgccggcggtatgcggctcgccttttctgatgccttgcattttcaaggtctgcaagaagttgcgtagtggtactgcatcccttagccgtggagggccagcggcgctgatcaccgagacgctgcggtagatgcctcctcccatacggttgccggctggaaggcggtgcctgtggtgcctggcggggggcgggtgccggggccagcggcgggaacgccgtggcggccgcgctgtgggtgccggtgcggatccggtcgtgctgcagggtcagggtgttcgcggagatctgccactgccgggcggcggcccggactgggccgggctcggcggcggcggccagcaccaattgcgggcaggccacgccgtcgtccgggtaggggcgcagggacgctacccagcggccggcggcggctcagcaccacactgctatccaccctcggtcgcctatggcacgaccaccgaggtggatctcaaccagccagcccggcccctgctggattggccgggcaccatcggaccagctggccccatgcgcgcccgtatccggatcgtctcgcccggagaagccggttgtatcgacggggtgactacttacacccctgcctggcgaacggcggtcacccggaacggatggttgctgctctacgccgggcatcacctgtgggaccccgctgaagccgcaccgaccgcagcgtcgatcggcgcagcatggcaggccggaaccctcgccgcagccagactgcgaacacgtcgcaccccagaccctcctgatgtgcttttaacggccaacggcggccccgcccggacggcttcggttctaacggtcgtcgcattactgtccttggccatccgggatgaggtactgccacttgatgtaaggcatccaggtggttctgccggataggtgaggcacgaacgagtgtcaatgaccaaccgatgtgaccggtgatctctcggtccattgattggattagcggtcagctaccatcccgctcgtgtcagttaccgatgccgccgtcgcggcggacctcgttccagcgggacttgagttcttggagcgggtcagcgatgaggtcagcttgccgctgccacctgctccgccttactactcaccggccagttgcggaccagagcacggaaggttcgactcggacgagatggtcgacgtcgaagaccccgagatgccggcgaaggtcaacgctggctggctgcacatggctaccgaatacggcgtcctcgacagccgtcgtgagttccttctcaacgtcaactacagcgaccctgaagaggtcgaacccgagtacgcctgggtcagggtccggctgtcggaccattgggatctggccggaggccactcgaccgccctgcgaagcggcttcggagggctgttcaccgatcggttcgtgccggagttctccatgctctccaccgaccacaaggcgatgctcaacacgaccgtctggggcaacggcaccgtcagcaccatcgtcatccgccccgaccgccgcgagcacacggtcgattgacgccttcagcggctcccgtcctgaccaaaatcctgcgagttacttcatcttcaacggcgaaccggactccgttgcttgccactcaaaatgaggcagctcagctcagcggcccgccgctgcctcaactgtcctggcaaaggacaattacgcgccggaccagcggtctttcacggcgatgccgttgcgcgggagttcggggccgcgggagaacacgctgacctcggtgatatcggggtgttcggctgcttcgatgaggcgcttaagcacgtcgagtacttcggtcagctgcacaagcgcctccttagggggtggtcggaacccgccgagtctagatcacttagagggagtgcttacctcgtccgctcgctgcggaactcgtcacagaccaggcgtggaggatcgtctttctcgtacacgcggaagtagcacgaaagccggaaccctcgtccgtgctcgtcctcccattcgacgtcgggtacccacatccaccacaggttgccctcgggattgttctccgggcggaccgggacagcctcgatacgggcgtcgacgcgtttcagcagccgccaccatctttcgaccttgatgtaaatctctgcagggggatgcacggcgtcacgccagcgtggggcttcaaccttgaactgttcgaggtcccattcgaccggagtgccagcttgaccagccacgcataccccctgctgtcagtgattacttccgggcgcgagacgccaggtaggcctcggctgcggccacctcggcacggttgggtcgctcatcgtccgggtcgtcggtctcgtccgggcgctggaaccagtcgcgcaggagcgcccactcgatgcgggattcggagcccggtttggtggctgtctgccacggctgcgatgcctggatgagggtgcgtaggtcggctggtgacagtgcgctgtaccgggcgatgacgtacccgatggtgttcagggctgcttcgtccgtgatctgaggctcagcgctgtccgcgctggcgtcgatctcaacggctcgttcggtggcgtgcatgggctcgtcgaacagggcccggtcgcgccaggcaaggtggtggccctgcataaaaaacatcagcatgtgctgttttgcgggcttcaggcccggccgtcgggtgttgatggcggtgatgacagagctggcgctggtggtcatcggcgcaacgtacggcggcgcgaggtcgcggctcaagccgtccgagggtgaggtagttggcacatccacggacgtggaagagtccgcgttggtggcttcgccggtggtcggcgctgaactcttcacaccacgaaacgtatcgatgtcgtcactcgactgttgtcggatcacggacttgtcacgaaaggtcatcattcctccatgtgcgaacccggtggtgtcgggctatgccggaaatcgggctgaaatctgtgggtgctcacggacgcgcaggctgacttcccagcgggtccagtcgtgtccgttcttgtcggctttgcgatcggctcgtcggcgtggaccgtgtgctgcgcccataccgagccgagttgcttcaggaagggtgccgtctccgattcgcggcagcgagagatcaggtttcggatccaggggatctcgccctcacggtggatcatcggtgcgtccacggtcacgccccagcatgctggttgcggtgagctggcagatctcgtcgcgggctgctttcgctttcgccagcgcatcctgtcggcggcgcgtgaaaactggatctgacctacttttcgtgatcgggattgacccgttaggcgagaaggattcgtttgcgtagcagatcgaggttggcgcgaccgtacatctggcgcttgatcatcttgatgcggttgacgtgcccttcgactactccggagctgtaggtcatggtcagcccgttcacgacggcgtcgtggtcacggcgcaggccggcggtgaaggatcgcaggtcaggctggtcgtcggctacgaccgcggcgatccagtcgttgagcctctgcccgtctcgggcggtcaagatctcggcgaacgccgagacgtgggtggccagggcgtccagatgtgggcaggcaccgcgcgctcgtgcgagttgttcgcggtcgtcttcagcgagtcggtcggggtgggtgagcagccagctggtcagctgacgggtttcggcggccgacgtggcgccggtggtcggccgacggcggcccgcagcggccgtaggtaggtgcgcaggtccatggggtgccggcggtcgcctcctgttgctcgacctcgcgcagcgactccagggcctcggcgatcgtgtcctcggcggccgggtcgtgggcccggatcgacgcggtgaccgccgcggcgtgcgggccgctcatccacggcagggtgcgcaccagggtcggcacggatccggaggccagcaccacggcgcggcctttgggcagcgcgcccaggtcggccacatcgaggatgtcgagaaattcgacgtcgtagctggtggaacggccatgccgggaatgcgactgacgaagaccccaccgatggtggtgggggctttcgacgcgcggccagcactcggttggggcaccgaggcgacggcgctaccatctccgccgacaggcattaccaccgcgccggccttggtcagccgggcgccgtggtggtcgcggtcgagcagggtgacgccgagccgccgttcgagccggctggtcgcgcgggacaggggtggctgggcgatcccgaggcgctggggagtgctacggcgtcgagggccatcgtctgctcaccgggcgcgggcagcgcttggcggggagggctgagttgtcgggtacgttctcgcagctcgccgatgaaagcgaggtcgatatcgatggcggccagggcctgctccggctgctcgcccgcctgagccgaacgtcgcgacgcctcggcgactgcgagcagccgctgggactggtcggtcaccgcctcgctcaacccggcctgcatctgccgctcgatggcgcggatcccgtcgcgtgcccgcttgccgacggccatccggaaggtgtcgatgagcgacctcagctcggcggcgctctcgctgttgcgccggctgcgctgccgctgcttctccccggctagggcggtcccgcccaaggcgatcgcaccggacgccgcaacggccgtggacagccagtacggcatcgcgaggccgaggaaccggggaacgatgagggcgatcatgatgccgctgtaggctggcatgagtacgccgaccagacgggtggccatcgtctgccgctcagacagcacccgtgggccgcggcggatgtgggcgaccagctccgccggcggttcgaggtcgagatgcaccggcggcacggcctcgctcaccccgatcgaggcggcgacccgctcgccgatctcgcgcgcggccacgtgcaacgcccgatgtaccgcttcggtctcgaccacgaggcgctgtcgcagccagccgtcgaggtcggcgccggccagcccttgtgactcgatcaccgcgatgccctcatcgagcagggctcgcaaccagttgtgcacggcgaactcgatgtccgacatggtcgccgacaacgcgtcgctgagtgcccgtggccatttgccggcttgtgcctgaaacgcgcgaaggcggccctcgtcgtcacgcgcctcgaaggcgaggcacgcccggcggcgggggtcggccatcgccgcacgccggctccgaagatcgacttccagcaactgcagggcgtccatcaccgcttccgcgacgatcatcgtggagcccccgccggccagctccgcggcggccaggcgcatccggcgttccagatcggggcgtaggttggcggcggctccctgcagcaccttctggatcacgtccagaaggtcgtcctgaatgctcaggccgctcggcggggtcatcgcagcctccgtcaagtgccggtgcccggccggcagccggcggcccgttgccgccggctgtcagcgcacgtcgtcagtggcagaacgggatcatgtggtggtcgtggcccatcgaaccgttgccgccccggcccgggtcgcagtcgtcggagctgccccggcccgggtcgcagtcgtcgaagctgccctggcccgggtggccgccgtgaccgacccagccgtggtcgccgtcggcgtcgtcgccgcagtcatcggcgccaccccatcctccgttgtgctgctgcccggggccgatgctcgtgtccccgccgccgaacaaaccgcgaccgaggtcgagacatccgctgccgccttcgagggaactctgccaaatgctcatttcacgtccttgctatcgggggggtctgacgtctacgccaacgacggaaccggccccaggacaccgagtccatgcgggcgacaaacctcaccaccggggatctcgcccaccggacatcaagggccacctgcccaaagccgacctcgtcgtcgacgcgctgccctggaagctctgcgacaccgaagcgcagcgcaagcgcgcccgcggccgcgtcgcgtccctcgctcactaggtcgccgggatgctggcctccgacggctggaccgtcgaggagctccgggaagccctcgaagcatcaccggctgccgccaacgcctcggacccggccgcccaggattcagtacggccccggaccaagaggtgttggagcagctgtggcgggagctggcaggcgtctccgttcagcgggccgcggaccagctggcgtctcgggcgcccgagacggtgatcgccctgatggagcagctgaatcccatgctcctggccgctctgactccattagggctatcagagcgctcgcggcagcgtgcgcactccgttcaagcggcgccgattccggccgaagctgtcacgccggcagaaggcggtcaaccgggcacacgcgaagatccgcgcccgcggcgagcgggcgatcgccacgctcaagacctggaagatcttggccaagctgcgctgctgcccgcgccgcgcgaccgcgattgtgcaggccatcctcgcgtcctgcaccatgtcgaagccggccgctacgcacgatgaaaaaggctcactgatccactcaacgcggacccattcgatgcggccgcctttgccgtgcaccttggcgcgtttgttgggcagttcgaggtcgccgatgtcgaggggtgaggatctcctcggcgcggacggcggcgccgtagagcactcgccacaggatcttctcgagcagctgcacgtcgaggcggaacagggcggcgccagggcgctgaaccaccgggtaagggcccctgcagctggtcggcgcccgcctcgctgtcgagggcggcagttccatgccggcgggcagcacccgcagcaggccgtcgagggtctgcgggtatttgaccgcgatgcccggcgaccaggcgacgagccgttcgcgtggtggtccagctcgccgaagacgcgggcgagcgcctgaggtgtcgacgtcatcccacgccttgtctgcggcatcggtacggctacgcacccatcgtggtgtcggacgcgaacgcggcatccgacgccgtcttgaagtcgccgcccccacccttacccctcaggtcaccacgggcggccttacgacggcgacggtccaacgcgcggatggccttgtccccgcgtcgggcgctgacctcttcggccggccgtgttcccgcggctcgccgtcgcagcaataacaggctgagcggccaccgcgatcaatgacggcagcgcgaccgcaactacgatccagacgccgtcggtcatacggtcagcatgcactcatcaagcaagcgtgccaggagcgctgagggcacatcggtggaaagtcccgagcatctggtgctcgaactcagctctcgcgcgactgtgtgacggcagatgtacgagaggctcgattcggcctgctccgccgaggcgtcccgttgggtggtcgagttcaggcgactggcggccgctccctcgtccagacggtgatgtcgctgctggtggcgaccaccaaggtgctaccggagggcgagaagccggccgctcgaagctccgaaaatctcgagtggaaaatgtgccaccacgtggcgccctcctcgccgctgaaggggtcactcctgtaggagagcagaacacgctggttcggccagtcgggactgacgacgtcgatcagccagccgtcacgggtgccggtgtgcaacccgccgccgtgcaatccggcgatccgcacagacgtcgccgcgatcggacccagcccaggacagcacaggtctccgtccgggcagggcacgccggggtcgaggtcccggtctcgagccagcttctgcccgctgacggcatcgaacaagccgtgcccgtcggaggaggtcaccagcaatagatccctgcggctggccgggtccgcggcgaagccgacgccctgcaggcccccgaccgaggtgcacggcgtcttcgcgggccgccacggttgaggcacggaaacaacccgtgactgcaggaagcgtcttcgtagtcttcgctggtgatccgtgagttccgcgagctgcggctcagcgtccgccaagtgatcacccatccacgtagtctggaccatccacccacagcgcggcgaacgcagcacgggaagtggtggcgaggtgccacggatactgaactcctagatcaatcacgctttcggcgccagagccgagtcttggcccaccccgcggcggagcggtgaggggatcggtttgctccgacgtgagcgagcctgccatgggccgcggccgtccgcccggactcgcggctggaagggctgtcgatccggtcgctcgcggccaaacacggcgggcaccggcggacagttcgcgaagcgccgagttcggcctggccggcaccgcggagaaagttgccgccgcgtaagtcgcggttggacccgttcaaaccggcgatcgacgtcatgccgttgaccgaattcgatgcaccgcgcaaacaacggcgcacggtgaagcggatctatgatcggctgctggccgaggaggagatggaaggcatctcgtatgccgctgtctgcgactacgtgcactggcgacgcccgcggatccgggtcgaggccggccgggacccaccacaaatgttcgtgcctccaagtcgtaagggaaggccttcatgccgatgagacgtcgccctaagtcttacgtccggaccatgctcacggttggctctgcggccgcgttgtccgccgcctgcgggcaggccggtggcccggtagcaaccttggccggcgcacctcacggcatcgtggtgaaccgtggtggtgtcgtcgaggtgctcgatgacaccaccaccggcaccgtccgacaggtcaccgagcaagacacgggcggtaccagcgcggacccgctcgccatgaccaaggtgcggcagctcgccgcacacaccatcgccggtctgcgcgcaggacggttggttgccttggaccccgcgcatgccgaccgaccgcggaccgtcgcgccggccagcgattggttccccgacactgcgctgaccggcggctgggccgtcaccgaatcgctgaaccagccgccgtgtcccgcgatcgacggcaccgccgcaggcacaacccgctaccggctggaacgccacgacctgtccaccggcaagacactcaggacgacatgccggccgtgtggtccggatcccggcttctgatcaccaacccgcagaccggaaccctcaccacctatcaggccaccaacggcagcgttctcactcgcagcggcctggacactggcggcagcctgcaggtctggggcgctgaaagctagcttcctcgtcatgcggccttgcgcgggtactccaggcggtgaatcttggacccggtcgcgtatccgtcggggggcaggttgaggtcttgtccaagacgtggcatggcgttatccggagggcgtggccgaggggtcagccgggtgttgtccggtggcgttggtagtgacgggcggctttggcgcggctgccgcagccgtccatggagcaccagcggcgggtgccgttgcgggagatgtcaaagaagtagaggacacaggcggggtgggcgcagcgccggatccgggtgggatcctggcgtatcaggtctaggtaattacggacggcgtgccaggcggcagaccagtcggcgtcgacgtccgagccctcacgcacggcgccctggtgcagcgtgtaccgcacgacgccgcgcgccaggatcgcgttgagctgctgttcggcgtgctcgtcgggttgttcaagagcttgccgcagcgccgatcgggcctgtcgcaggggtgccgcgacggtggtgtggttgccggtcaggtgctgctcgtggagccatgccagcagtccgccgggctcgtcgaagaggtccaccgtgcggccatggtcgacccactcagtgttcaccaggtccagggccagcggttcgccggtcaatggtcgtgccgtcactcatccatcttaccggcgtagtgcagttgacaggtaagacgaaagcgatctagcttctaaccactaaaacctatttcagtggttaggggtggaggatgccggacagctggccggaccgcggatggtgaccgtgtcggtgcctcctcctcacccgcaccctgatctgaccggacgcgccgcgccggcacgacccgctccgcggctgccgggcgccgcgtatctgaacggcccgaggggacgccgacgatgccgcaccactaccttcagcacctgacgaccgcgccggttgccgccgcccaacagcgctacggcagccgtgccgccatcgagcgcatgatcgccggctgggacaccgacgccctgctcggcgccgacgagatcacgttcatcaccgcccgcgacggcttctacctcgccaccgtcaacaccgacggctggccctacctgcagtaccgcggcggcccaccgggcttcctgcacccgcttgacccggtcgccgggcacagcgtcctggcctgggccgacgttcgcggtaaccggcagtacctgtccgtcggcaacctgggctgctcaccgcgggtgtccctgttcctgatggactacgcccaccgtcgacgactcaagatcctgggaacggcaaccgtccacgacatccgcgacggcatgccggcccacctcgccggcaggttcggcaccctccgcacgcccggcgtggtggaacggctcatcaccgtcgaggtccacagctacgactggaactgcccgcaacacatcacgccacgctggaacgaagccgaactgcacgacgctctcgcgccgatccgtgaccagctcacccagctccaggcggagaatgacgccctgcgcgacatggttcgccgaaaccgcttccagcagcacccgtcccaggagacctcatgaccagagacccatccagcacgccgcaacccccacggcatccgctgccacccttcactgtcgacaccgcccgcgccaaagtccaggccgccgaggacgcctggaacacccgtgacccccgacgcgtcgccgccgcgtacacccccgacagcatgtggcgcaaccgcgacacctttctgaccggccgcgccgagattgaagcgttcctgacccataagtggagacgcgaactggactacgccctgcgcaagcaactttgggccttccacgacaaccgcatcgccgtgcggttccagtacgaatggcacgaccccagcggccaatggtggcgcagctacggcaacgaacagtgggaattcgacgagcatggatacatgagtcgtcgcgaagccagcatcaacgacgtggcgatcaaccccgaccagcgacgcatccacggccccaggccggcccacgacaccaccgacatccccttgcgctgagcgcggactcaccagcatcacgaatcaggtcgtacgacagcgccgcctgcgcccgaccgagacgggtgcaggcggcgctgtgtgatgcccggacgcgaagcgcaggcagccgggtggaccgactcagaccaggcgccggaccacgtagttcctactccagatcttctgcttggtgaccgtcttgccggcccgcggggcggcccacatcatgccgccaccggcgtagatgccggcgtgcgtgccgtacgagccgtcacggatgatgatcaggtcaccggggcgggcccgggacttggcgatggccttgccgtaccgctgctgcaggttcgccttgtgcggcagcttcttgcccgccgccttcttgtagacgtacatggtgtagcccgagcagtcgaaccgcttgggcccggcggcgccgaacttgtacagcttgcccttgtgcttggccgcttcgatcatgatccggttcgcggccgcccgggacactgccgccttggactgggacgccaccgccttgagggtgaggccgctctggctgaatggcacgcttgtctgtgagaacacctgcgtggtggtgacggccggcgacctggtcgcggcggaggccgactgcggtgtgtcgaggagaccggtgagaagaccgagacccacggacagggcgatagtgccggctcccagggtacgggcgggtcggctcgaagtgcttacgcgcacggtgaaggaatccctccggcacgcctgcgaggttagctgtcggattcgggcgcgaaggttgcccggccgcacactggcggcttcaccccaaggtcctcacgtcccgggcgccgcagtacggcgtgccggtcgaggaccgatgatggttcccccgtccctgcccccgattgcctcatgactcgtcatgcgggttcgtgcggccggaccggggcagggctcggcgtggtccgatcgacacgaccggcgagcacgtgcccgccgctcttccttaatagcccagcccaccgggttgttccggaatccggtcggtcacgttgagtgaatgttgcggtcatggctgcctgatttctagctagctagagaaggccggtgccggaatatccaacgcccgctgtgtacatacagtaacggaaagctgatattgatctgtgaaagggaacacgaggaaatttgagccgctggtctgcgtcacctcgtagcgatcctccggtccgctacgacaggccaaccgccggtccggcgatttcggccgatcggccggtcgccgtcgccctaaccggggccgcccgggtggcgacctgacgaccgcccgccggaagacacataggcccgcggcgattgcaagcacagcagcgacaccgaacatgtccacggtgagcaacccggcgctcaggccgaacgcgctgtactcagatgtcacctatcggtgcagcagagccgttcgctcggcttactggcaggtgtcgtcatgccacctacttcaaatcctcgatggtcgttgtccagtctggcctccgacgagagccgtcgggcatcgtcggatcaattgccaccttgatgtactcggcgcggccgcttgggcgcgtcccgccacgagccatgcgctcgacttcgaggcctgcgacgtccagtgcgagcacgtgtgtaatcaatgcgccgaaccgttcggcgtgttcgatgagcaggtcctgagcctcagccatgtgtgccgctgacgttcctcgatggccggtaagcgacacctgcttaccaccacgagtccgtgcaggggtcacagcgccgagtaccggcgagccacacacgttggatcggcggatctgacccagatccacaccgggcaggtcggggtgccggtcgttggtgccgaacccgcccagtaggtcaatcgtggcgttgtccccgacagcgtccaatgcgtcggccagcgcgccgtgagcaccttctctcggtaggcagatgaacgcaccgtcaaggcgggccgcacgacgttgatccaacttcgtcgacgtctgtgtggacagcagctgcacagtggagcgcagaaaggccagccggtcggtacggcgatgaattaggtgagcacggacgccacgaatctctgcgaccagggcgacaagcactccggtcgtgccagcgccccagatccctaccgaggagcggggtgccgcgagttcccacccataaagcactgccgccagcggttccacgaggacggctagatcggcaggcaggttcggcgcagccgacaccagaggcggcctccccggggcatcgagataacgctggtggataccatcgtagctgtgcccgaggatgcgatcctggtcatcggggtcaaccggattgaacaagacgtagcgtcgctcgtccgggagtattccgagcccttcatgaccaaggatccgggcagcgtcgggccgcgcattccgtagtatctgcaggtctgttccgcatacgccggctcggaggatctgaatcgcttcaggattgcacgagccagcgaatcgcagggttaagcctccgttttcgcggacaagcgctgcgttctcatgccgtccgtcgccggtcatacctgggcctcttccgcctgggcgaacatggcgagcaactcgcccgcgcgcgcgagctcggcattggtcacaccctcaacgaattcggcggcgccgatgccgacgggaagcgggcagtactgattaccgtttcggtgccgggtcgactcttcaagaccttcctgaagtaggtcgacatcgcatgtcgggtgcgtgatcggaagggagtaccggtgcagcaggttcagtatgcgcttcacgtcggtggccgagatcagaccgcgtccgtatgccagtgcgcagcaaagtgccatgtcgatggcaacagcttcgccgtgcagcagtggaggtttggcgcacatctccagccgcgggctgaaggtatgaccgaaatcgacgagtcgtcgcagctcgttctcccagagattcggctcgagctcctccagcatactggtgatggctcggttcatgatctcttggccgtcatcgctgaccaactgcgcggcgatcaaaccctctggatcgctttcgagaagcttgaacaggacgggctccttcacgatcgccatcttgatgatctcggccatgccattgcgcacatgccgagccggcaacgttcggaggaactgggggtctaccaacgtgttcgtagccgggtagtacgttccgaggcgattcttgtgctcacccacgttgatgccggtcttcgctccgatggcagcgtcgatcatcccgaccagcgtggtcggaatccggacatatggggttcctcggcggtagaggctcgccgccagacccacggtgtcggtcacgaccccccccaccgaccgcgatgatgggatcccgacgcctgatgccgacctcgtccgcggccgctgcgacggcaagtgccgtcgcgctggtcttcgcatcctctcccgcctgcatgcggaagaccgtggcagcaactcctcgcgcggagaaatatgcccggatctgctctccccaaaggtcttgcacattcgcgtcaaccacaacgagtcggcgcgcgtcgccgcggaggccggcggcgtccgccaaggcctcgttgcgcggcgagaacacgtcgctcgtgacggccacccgatagctcacctcatgggtgtacttgacgtcccaggttttcattgaatcgccctcccgttccttcgggcgtataaccccgcccctttcaatgcctcgagtccgtcgccatttccgattttgatacgtcgatcaaaatatccagagtcacgggacgtgacctcgtacaaccccagccgtgcaaggttcttcagaacgctgtcccggtagatttcgccgagttcgtcgactacgccgccgagcagtaccgtgtgccgaacctgtggattcagcgtggcctgatacagcaggaccgtgctgagcgggagagtgaaggcgtcaagcagctccagggccagtgcgtcaccgcttcgacacgcttccccgaaggcggcgatgttccagtcgggtccagccagtcgaggcaacaactgctcgatcgcccggccggaggaaaacgcgctcacatggtcctgaacgccgcattcgcacacggcgctgagataggtcccacgccaagggaaagcgctcggcaggtgcccgatctcgccttgaaccccgtggtcgggatcgagagggatatggccggaggcgagatctatcgtgcggtatgcgatgccggagctgacggtgagcgctgccgccatggagtcacttgaggccgtttcgtccagcagcgacagtgcctgtgccgaaacgtcgttgaccaccgagtaccgaaccgcgggaagcgcttcacacagcttctgcgtcagcggcagctcccaggtaccgggcccccacaggggcgcgctgctcaggaccaggccggtgtgaccgttgactgcggcgccgatggagattcccacgtcagtcgacgcatgtcggacacattcgtcgacgatgaacgagaccattcgttgctgcagttcggccaccggcagttccggatgtgtcgcacgactgatggcaggatacctgcccagcagagtgacgcttccgtcgatgtgcgaaaggccgactcgaaaccacgttccgcctagatcgaagacaagcaccggtgttgtcaacgctgatccgtcccatcccccagggcagttgctgtcagccacttgtcccgatctgcgagcagcccgacacggttccaccatccgtcagagcctgcctgccagatggtgggccgacctggtccgctgtacatctcgcacgcggcgccgaaatgcctgatgatctgccaggtgtcgactcgccggcttttggcaaggtcgatctccacgaggggatctggatctacgatgccgggcgagacggtcgcgtcggatgtggcctccgccgcacgagcatcggtggcgatcgtcgaggcgaggcgggcgatggcgcctgcgacgtcgcgcgcttcatcgcagggttcggccagcatttctgcgaaccttcgcgcgccgaggagaagtccgccgtcgcgcaccacgtccgccggttcgtcggcggtgtggaagtaggtctccacccgactggggctggcaaggtgtgcgcggagttcccagccttcgcggttcaccggatccgcaggccccttgacgtctgccatcagcacggtgaccggtacgtctatcaccgccgcggtgcggcggaactggaccaggatggactgcgaccacgagaacatcagatcgagtagcgccagtcgctcaccggatgccacgttgagctggtatctccagatctcctcgtactccttcgcggtgatctgaaccgggaagtatgcgtacgggtggcagtcgaaccgacgcagatactcgagagtgggtacggccttcccggcggcgatcgcgtctggccggaacatgccgaggccgacttgacggatctgcatacccagcccgctgtcgtcggcatgggtggcttgggcgcaggcgtaaagcgtctgacggaagcgagcctctacggcataagcgtcagccttaccatcaacggtggtcagctcttcacgaaggaaccggcgtgtataggccgcatcaaagaacctacggctgtccagtctgccgggcgacatacaccactcctctcatgaagtccgggacatacaggaagtccgccgtggcgaacagcgcccgtggcggttctgccatgtggaccggccggggcgagtccgcggggtggaccgcgagctgggcacggtgccgccatttcgagtcaaaggtcgaaaggcaacccggactttctgaggaaagaagccagccatcggggatggggagcaggaaacgagggtattcgatcgcctcttctgcgtcgtctccgagcactgcccggaacgcccccgtgctcggtgcagcctggagcacccgatggttcagcgagtcgacgacgagtatttcgtccgttcccgtcagcgggagggtctggtgcgggtcggacagtggcgccaggtctgccaacgggctttcggtccagcgccatgacacggtgccgtcaagcgtgatcaacaacacgtcattgagggagctgtccgtcaaccagaagctgttcgcgtcgtggtgagcaagatggtgtggatcagccagagcgacgggacgaccctgccgatcgcgcacctccagagggatccccggcgtgtccgctgacaggtgtcgcggatgtttacgaaggacgctgccgaggccgtcggcaaccagcacggcgtcgtccaccacgatggcggaacggggccagccgggcacgggcagcgccagcggcggatcaccgggaaagcacagaaggcggctgttgttcgtgtccgcgatcagcagccgctcgtcgacggacaggattgcacgagggaacgagaattcgccggtggcaggcgtcggctccgggtgggcgacgttctcgagcgtccacctgtccctgttcgcggtcagcaggtggaggctgcccgcatacgcatcggagatcagggcatgtttgtcatccaaggctgtcatcgcactcgccgaacgcacgtgcgcgccgggaatgctcgcctgaatgacgtttccatcgagatcgagcgtgatcaggtctgaggaccgccgattggcgatcacgatcgtgccgtcgagagcacagcaggcgatcggcgtgaacagcgctgctatgtcggcacccggcttgccgcgttcgcctcggcgccagaggatcctgccggagaggtcgagacactgaaccagatgaagatagtcgtcggtgacgactatgcgctctggtgaggcgaaacaggcgtcgcccacgtgtgccgcgtactctcggtcgagggtcaccacgtggctgatccggtcgccgatgaaaaggaccaggctcggtgggtcgacctcgtcatagtcgttcagcgcgacaaggctgaggttctccgtccacgcggcgaccgcactcacccgcgtccgagccccgttcggcaggccggccaggtgacgttgaaggtgcgcggcgcgcgtccgtcccagctgcagcgcccaccaagcttcctgcgagtgccagtgaccgaaccggagcacaggctcgtcgccgtgcgcgaggtgtgcctcgtggacgccgtccgtagcctggtcatgaagaaagacactggggccttgggaccagagcctgtccggcgtccacaacggcgcggcgccgccggccggacgcaccgtggcatcgagtagcacgacctcaggaccccgtcgccaccgaagagagcacggcgccgttgcgaaggaccttggcgaacgccgcggcaatgtcgtgcatatccgcctcgtcgccgagcaatgcggcgtggtggaaggtaagcacacggccgttcgccgcgtcacattcgggcagctcgaaccgggatgtgtccaacctgcggaggtggtctgcgcctagtgcgaaacgacgcctcgtctctggacggtagagcttgcttcgcgacagcgtcaggtaaggcggcttcaccgggaaacccagctcagcactgatcgcctcgcctaccagctcacgcggcacgcccggcagcgcaccctccggaagcgaaacagcgtacgcgtaataggtacgcgccgtcgtacctgaagaagtctgctgagggcggcaaccgtcgtcggcgagaagcttgtcgagcagcatcgcgttgcgtgctcgagtcgcgttctgtgcatccagcgcagtgagctgtgcgaccagaacggcagcctgaaattccgaaaggcaacgattgctgcccatctgctcgccgacctgctccagctccatccatcccggcctcggagggacttttgccaagcaccgaccgtcggcacgcagttgctccatccgccgggcgagtcctccgtcggaggtaatcgtcgctccgccttcgccgctggtcaggaccttgctgtgctgcatgctgaacgccccgacggcaccgatcgtgccgaccttgcggtcgcgatgggcagcgccgtgagcctgcgccgcatcctcgatcagggtgatgtcgtacttgtccgcgatcgcgctcaagcggtccaggtcggcaaccgcgctatatagatgtacggcgataatcgccttcgtccggggtgttatcgcggcctcgaccgcgtccgggtcgatacacagcgtgtcagggttcacgtcgacgatgaccgggatcgcgttgaccgccgtgatggtggacagcgacgccacccacgagatgcctggcgtaatgacctcatcgccggcgccgacaccgcaggcctccagcgcgatcatcaggctcgccgtgccgctggctgttggaatgcagtgcgctgagtcgttataggccgcaaacgcgcgagcgaactgccgctcaaacgactccgtgccacggtacgggccgctgatggcccatcggccggagtggagcacggtttccagcgcctgactcgcgccttctgcgggacgtggccacaccggccagggcgcagttcggacggcctctccgcccctgatggcgagcctgttcatcattacctctcctcaccaacgcacgcgcggtacagaaatgccgcgccgtcaagacatgaaggtgcattagcacctgatcgcacgattcgtagatcggcagaatttcgcaatccggcagcggagtccgacgcatcggccgcacgccggcgaattgcatgccgaaggacacgcgattcgcgctgcgttagcgctcagtcagacaggcgactggcgctgcaaaacccccggcgcgtcgccccttgggcataccgccaaggttctaacgcaatctcgacagagcgagagcgtcgccctgcgcttggcccgaaagagaatgctcgccatggccgtacacggacggtgacacgctgcactgctttggctcgctcggcggacatgggggaggccagagacggcctgtaccgttgcgatgagtttatgttcgggatccccgaccgcattctccggccgtgcggggaagcacgcgacgacgccctgggctcgcgacgtgactctgttcctgacgacggcgacattcacgtccaccgaatgatagccccgtggtgacgcacacaagcaagagccccccgttacggaataccgaatccacgcccgactgatccaggcgctcggagcaacctacagcagagatcaaccatcctccacccggtggggccaaagggcgataggtgcgcctcggcctggaccactgtggaggccggacctggatcggtctcggccgcccgagcctcctgcatcctgcagggactggacacaagaaccgttgcgccgcaatgaccctctacggtgtacgccgatgcctgccgcacctgctcggcacctgcccgacctgccaagcccaccgcacgcaaccgaaatgcagacgccgtcgaagaccgtgacaaggcactagtaggcaagtgccgtgtaggtgccgccgtgccgcatcagcgggcgcccctcccgccaggcgagactggtgggcgtggccagcacgatcgcgtgtcggccggcctccacataatgggcgaccttgcactccaggtgcgccaggactgaccccagcaacgggcatccctgttcacccggtcgccagtcgccatggatggcaagcctgtcgatgccgggtgtggcgaagagtcgagccacatcctcctgatcttcagagagaacattgacggcgatgtgcgaggcgtcccgtaaggtcggccatgctgatccatcttgactcacacacacggaaatcagcggtggatcgatctccacagaagtgaacgacgttgcggtgaaggcacgcggtgagtgcccggcaacagtgactacgctcacagaaaatgccacctggcgcataaggtcgcgcaactcacgcgtgctgccgtcgtggtgaggctcgcttccggacaacgtcgcatcgtctccttggtgtcgatggctgggagcatgggcttcgaggcgtccggccggcacggcgagcgtgctcttcagtggacggcggccggcgatgcggccggcgggtcgacacacgactgtcgtcgtaggtcaccggaacgggtgccattcaagcatcccggcgcgagtgacggcgcccagaggggtcgcggtcgcgaggcgaccgagctcaacgccgacgggcccggcgccgattcaagcgacgtttcgccgggatctgccggcttccgcggagagatgcgcctgtgtcggccgcgccgcggtggtgaacttcagccggccgcgttgaccgcatgtcgcgacgaaggccatcaagcccgctgggacctcggcgaacggacctcccgcgcccgggccgctcgacaccggcgctcgggaatcgatccgtcgggattggagcgtggtcgatgcgccgctgagtcttttgtgtcgggcgggcggcaccggctggcccgtggttgatatgatctatatcggtgcgagctcgctgcgccattcgtccggccccacattcatcatcgcgatgacggcccgtccccacggaccggcgggtcgaccgacgattccggtgacggggtcaccggtacgcatatccgatagtcaggacggttgtggggaacatacagatcgatgaacacgctgacctcggctgcccgccgggccgcagcggggacaatggcgaggacgccttattgcacagcgctctcgatgcggcggtcgccaataacgctgaagcttccgccatcaacaacggcacggagcgctggagctactcggagctgcagcggcagagctttcgcttcgcgaactggctgatccagctcggcgtgcagcgcggcgaccgcgtattggtacggttgacaaatacgcgcgagttcgcggcgatcctttttggttgctcccgcatcggggctgtcatggtgccgatcagcacagaaatgagacagttccatctgcgcgcggtgatcggggacgcggacccgcgactcgtggtcaccacggattccgatgtgccgctgatgagccaggtcaccgagcgaccggttcacgcgctcagcgcggtcgtcgagcagatgcggaagctcccgatgacggcgcccgcggtaccgacacccgcaccgaatgaccttgcgctgctcatctacacgtccggtagcaccgcgttgccgaaggcagtggtgtgcccgcacgcgcaggtcgccttcgccgcacatgccatcgcagcggagctgggctaccagacagacgatgtcgtcctgtgccgcctcccgttctccttcgattacggcctctaccaactcctcctggcttccatagccgggtgtgaggtgttcgtgccgccggcggacagcccggacctccagctcctgcagtggatccgccgacacggggtgacggtcgtccccatcgtcccgtcgctcggtcagatgctggtccggcttgccggacggacctcagaccagacgagccttcgcatgatcaccaacaccggcgccgccctgaacgaggacctcattcgacagcttcaaaaggcgttcccgaacgtcacgatcaggttgatgttcggtatcaccgagtgcaagcgcgtctcgatcctggagggcgacggagtgctgctccggccgacctccgtaggtcgcccgctcggcggtacgagcgtcacgatcgtcgacgacgacgaccagcccctgccgcctgggcggacggggcagatcgtcgtccgggggccccatgtcatggccggctactggaacgcgccggagctcaccatgcagcgcttccgtctcgaccgcgagaccggcacggtcgccctttacaccggggactacgggtacctggacgcggagggatatctctacttcgcgggtcggcgcgacgacctcttcaaacgtcggggtacccgagtcagcgttctcgagatcgaggccgctgcggtggacatcccgggcgtgcgcgcggcagcggtcctgccgcccaccgccgatggtgacctggtcatgttcgtggacgccgcactgacgggcccggaggtcctccgggagatgtcggtccggttggagcccgcgaaggtgccgtcgcactgccacgtcgtcgcctcgctgccgttgacccccaatggcaagaccgacaagaagtcgctggctgaccacctgctgaagggcgcgacatcgtgaaccgtcgtgagtttgtcgagcggttcggcagtccgctctacgtctacgacctcgaccgggtcgacgctgcactcgtggatctgcgggcgagcgttcctgagcaggcgacgctgttcttctcgcagaaggcgaacccacatcccgctgtcgtcgaacggctcatcgccgccggctgccgggccgaggtgagctcctccggcgagctggccaccgcgctgggtgtgggcgccgatccgcgcgagtgtctttacaccggccccgggaagacggcgtcagagatcgccaacgctctgggaagcggggtgcgccgcttctccgtcgaatccgaggcggaccttgagcgcgtggcgtcagtcgcgctggcgcacggcgtgaccgcggagtgcatcgtacggatcaacggcctgagccccgccggagcaagcggcctgcggatgaccggcatgccgtcgcagttcggattcgatctggcgacgtcgccgccggactggaaccgcctgctcgccaccccgggcgcccgcatcgtcggactgcacttctttccgctgaccaacgccgtcgaccaggagagcctcttccgcgagttcgccgccagcatcgacatggcggcgcagctacgcgacgagcaccagttggcgctggagttcctcgacatcggtggaggcttcggttgcccgtatgcccagccgggtgaacgccctacgttcccggacctgcgagcccagctcatcgaagtcctggacgagcgcatgcgcggttggcgggacggtaggccggaggtcgcgttcgaatccggacggtacctcgtgggcgatgccggcactctcttgtgcacggtcacggacgtcaaggtgagtaagggaaagacgtatgcggtgctggacgccggcatcaaccatctgggtgggctgtccggtatcggtcgggtgctgcccatggcccgcccagaggtggtcgacggcagccagggcggtcgaccggagagagccgtcaacctggtcgggccgctgtgcacgtcggcggacctcatcggccgcgaagttcgaaccgcggtaccggagccgggcgacatcctggccatcccgaacgtcggcgcgtacggcctcaccgcgagcctcatgggattcctgagccggccggtcgccaccgaggtggtggtgcggcgcggccatgagccgactgcctcacgtctcgagctgcgccgcacatctatagaggaagagaacaatgacgcctgaccttgacccgtctttcgtgcggctcctacaacgcagtctcggcggtgccgccgaagcggagccgctccacccggacgccgacctccgtgcgctcggactggactcgatgggaatcatcggcctcctggtcgacctcgaggaggagttcggcgtcagcttcccggatcacgcactgacgttcgcgacgttcgcgacgccgcgcacgctgtggagtgccctcgccgaactccggtcacccgtcgacgggctggcgtagacatggcgacgcctaccatggagcacaccctgcggtccgacgtacggcagcgagccgaagcggtcctgccgaccctcgccgcgcacgcgacccggatcgacgccgaggcgttgtttccggtggagagtctggactgcctccggtcgagcggtctcatgggtctcctcgtgcccgtggaacacggcggactgggcggtggcattcccgacctcatcgaggtggccggcctactcgcctcccggtgcctgtccacggccatgatctgggcgatgcactgccaacaggtggatgccgtcgtccagttcgcgggcccgcagctgcgcgccgagctgctgccgcggatcgcgggtggtgaggtctatctgggttccatcacttcagagcggaccaaaggcggccatctgttcaccagcgcgtccccgctggagccggcaggtgatgacttcctgctggacagggacgcgcccattgtcaccggcggcgcgtacgcggacggcttcctcaccacgatgctcgccgcgccggacgcgccaccaaccgaggtgacgctcgtctatgccgatcgttcacagatggccatcgaccaacgcggcacatggaatccactgggcatgcgtggaacgcacagcgtcggccttcacctccggggacaggtacccggcacccaggtggtgggggagcctggggggttccgccacgtagcggccaacagcctggtgcccctcgcgcacctcgggtggtcggcctgctggctgggcacggcaaagggggctctccgggagctgctcgcgctccgagccccccaccgaccgcgtggcctcgatccgaagtcggaactcgtggccgcgcgcgtcgcccgggtccggatggagctcgaggtggtgagcacgtacctcacccgggtgtgccaggaggtgatggagcgtcgagcaaacagccgagacctcgacgagcccgccacgcagatccacctcaataccctcaaggtcatagcgtcggagtcctgcttccgcgccatcgacggcatcgtcgagatcgcgggcctggcccaagggtaccggcgcgatgcagcagtgcctttcgagcgctacttccgagacctccgctcggcgagcctcaactacgccaacgaccgactcctggtggccaccggggtactgagtatgctggaccgctcggtgcgcctcagcggagagcagacatgagggcgcagtccgaggtacggcatgggctgtcgatgctcctcgtcgacgtcgataccgccatcgagaccgactggcacgggtacgagggccacgaggaccttgtacgggtcgaggatccaccggtcgaggcgtgggaggcactcgccggtgcgggtctcctgcccaagcctgagtggctgacctgggttgccgactgccagtcgagcgaggacgagttcctcggacgcatgccgcgcaaggaacggcaaagcatagccgcggcccgccggcgcgccgccgccgacggagtgcggctcaggctcggcgacctcgactccacctatctggatgcctttctgcctctctacgaggcgaggactgccgagaagcgccatggctggtccgtcgtcagcgacatcagaggcgacctgttggccgacgcggccgactacttcgtggtctctgcgtggaggggcgatgagttcgtgggcggatgcatcaacctggcaccttccgagggagccatgcggatccggttctccgcggtcgaccagtccggccggtatgccagtctggctcgggcgctgtacctggaagccattcgggaagcgcgcgtgcgcggctaccggtcggtcagtctcggtaccgacccgaacctctacgggcacgtggtcgagcccggcctgctgcgcttcaagtctcggctgggcttcgagcccaagccgtcgcatcaggtaaccggcaagcccgccagtgactgcgccgacctggtgctcgggttcgccgcgctcatggacccgacgatcatgttcagttaccgcaccaacgcggtatcgtccacggcatcggagctgcaggcggagatctacagctacagcgcggacgtcgccgtggaccagcacacggcagcgttgtcgttcccggttcgtagacacgtggtcgacaggcgcccgaccgcgtgcgcgaccggcaatacggcgcccaggtaacaaccgaatcggcggaaagtgccgcgtcacattttggctcactcggtctcgcaagcgactgaggggcgtggacccacgcgctttcgcggaggttcctccaacgaacggcactgagaaatgcgctgggggtatcgcctcggccgaccctttgcgggccagtcgcgcctcgctgacatgaagtggagtagaagtggtgcttgcccccgttcatcaacgcgcgcaggagtggtcattcctgcaggctctgtcggtactcgacgggcgccccggcgcacacgacgccgcccgtgcgctcgcggagaccgagctggacttcgattacctgaccgtgcaggcgctccggcaccaccttgctcccgccatgtggcggtttctcgtcgacaacgggatcgagaaccggttgagcgatccggtactcgcgtcgttcgggagcctcgcgcagatctgcgactaccggacggaggagctgatcgacgaggcgtctcgcgtcgcggacgcgatggccgccgccggcgctcgcctcgcgttcaccaagggcgtcgtgaaccagtccaccctgtatgacaactccggcacgcgggtcatggccgacatcgatctgatgatcccgccggacagcaccgcgatcatcacggaaacccttacgagcctcgggtactccgtcgcgaaggagtacgacgcgcgtacgaacagcctcgtggacctgccccggtcccgccgcatggtgtatcggatgtaccccgaccacctgccgcacttcacgaagctgacgggcaatcgggcgcagccgctgatcgagatcgacgtcgcgttcagcctcacctggttctccagcgcgtggcagatcccgatggacgcggtactacgcgatctggactcggtgttggtacggccgggacggtccgaccgcacccttccgacactgacgccggcatattcactgctgttcatcgtgctgcatctcttccgcgaggcgtggttcatcacgaagaagcccgtgcggctgaaccagttcgcggatgtcgtgcgcctctggcgtcggatcggggcgaaccacgcctccgagatcatcaaggtggtggaggacaacggcgtcggcccggcggtgggctgggtctgccaccacgtcgacgcgatgttcgataccgatatggcggcgacgttgggtacggagcggtatgccgaaccgcgctggctgaccagcggcgtcgcggaggacggcagcttcgtgcaatggcacggcgacatgcgcgcgaggctcgccggcggtgagcccgtcatcttcacgccggccggggagccgccgttcggggcggcggcgcgcgggcgttagcggtgccccttccacgtggcgggcgccgtgccgcccgccacgtgaacccaccggagcgccgtggggcagccccacggccaccaaccacaatgctcatctgagtcgggtgttcggtgcggaccggacggcgaatacaccgggagaagcagtgcgtgaggttgcggtcgccccgctgacactgggccagctgtcgtgtctgcgcaccctcgagcggatgcctgccggctcccccgatggcctcaacctggtgcggtcgtgggacgtcccgccgggccagacggtcaccagcgtgctgaacgcactggacctgctcgaggcccgacacgagtcgcttcggacgatcttcccggacaccccttcactcgcggtacgtcaggtgatcctcgcgccgcggggcgtatcggtcgaggtgctggaggtgaccgacgccgcagacgccgaccggcacgcgcaggagcttcgtcgacgcaccttctcgctggactcggagaaacccctgcgcggcatggtgttcaccatcggcggcgtgcccgtgcgggcggcgctgtgctggcaccacatcgccgtggacggttgggcgatccagcggctgcaccgcgagttcgccgacattctggccggccgcactctgacggaccccgcggtgagctgtcgtgaactggcatgggaggagcagtcggacccggcagtcgagcggaccgcgcgggcggtggagtactggacacgaaccgttggtgacgtgcccagcggccgagcggcctcgctgggcaccctccgtacccggtgggcgacgctgcgctcgtccacgatgcgcgaggcggcgaggctactcgcggcagagtgtggggcgtcgttgcacagcgttgtcctggccgcctactgccatgcgatcgccgagcgggacgacaccgattcaccgttggtggcgctgatctccggcaaccgggccggcacccgcatgaagcaggtggtgggcacggtggagcaggtatcgccggtgcgcgtgcaagtcgatccggcggagagcttctcggccctggtgcggcgggtgcactgggacacgatcacggcgtatcgccacggaaggcacaatgtggatgtcgtgtcgcgcgaggtgggatcgctggggtacgaggggtccggtttcggtttcacgtatttctacaactacatgccgcgccccgcgcggagtaccgtcgccgcaccagcacacccgccgacacggataacgacgcgggacgcgggccgggacaacggctatcccgtctacctcgtcgtcgatgacgacactgagctgacctgcgacctgcgcgatgcgccacccaccccggggtacgaaccgctggagcggctcctgtcctgcatccagcaggtcgtcgcagccgaggcggacggcggaagctgaccctcggccgcctactcgacgacggcggagatgccccgcgccgcagccatggcagcattgaacgacagattgctggattcggcgacggtgcgaatctggcagagagcgccgcggtagtcggtcggcggttggacccaatcccctggggcggcggagggcagcgcctgcacgacgaacggtgccgcacccacctcgtccaagccgcgcatctgaacgagtcgaccggccacctgcggatacacggtgaccgttgtcgacgcctttccgttgtggctgagatccggcagcggcatctgcaacgcggacaagctcaggatttccgagacggaactgttcaggcagtcgctcatcatcatcgtcagcagtccacccggatggcgcacattcagctccacgatggccgcgccgtggcttgtcacgatgaattccgtgtgcagcattccctgcctgatgccgtacgcctggacgcacgcctcgacggcccgccgcatctcattctcgtactgccacggcacctggacggggaaagtgtaagaaacctcgcagaaacccgggttggggccgatctgacggtcggtcactcccaggtggtgacacgttccgtcggagacaatcgtttcgagactgtatagcggcccggtgaggtattcctcggccatcagatcgccgtcgaggtaccgctcagcgttgctgagctcgaggtaccgctcgcgcgcctcggtggacgactccaccagtcgcacatccatactgccggtgccgcggcagttcttgagtacgaccgggccgccaatctcctcggtgaacgccacgaattcgtcggcgtctgccggcgccgcccatcgggcagaggtaatcccgagtttgtcgtacaggcggcgtgccgcccgcttgtcacggaaagtctgcatggccggcacagacgggtatggggcgcccaccgcctccgccagcgcggccgcgaaaggcagactgcggtccagtccgcacaccacgccggacgggccggcggcctgctcgatgctgctgacgagccacgcgggcacctcggtgacctcggaggacggcaccttgaagacacgaccacgactttcgagcgtttccatcacctcgccccccaggcgctccggcgcccactcggggttggcgctcacatatgcggcgtcgaagccgtgatcgacggcccaccgaacatgtgacattccggctccggtgggggccgactcaacgaagagaagcatggtgtactcccggttgcgtttggtgctggccgaactgcagcggccgtgatgttatcttgcgcggagatcggtggcgcctcggatcgacgatcgccgacaggccgacggtccgaagtgaagagtgccacgtggtagcctgaacgcggctcccacccggcgcagtcgggctgcggcgaatggttcccaccattctgccggatcgcaacgcactccacccgctcccgcggacggcgagcggtcggaaagcccttggtccccccgctccggcgaccattatggagcttcgccgacgctctcgcgcatgcgcgagtggcgcaggccgccggggccgtgccggggccacgtctcacgagtccgaactagcggaggcagccgctgcctgtgcttccaactggcgatggtgcggtgacagatcatgtcgagtaacggtcgattcggcgcgctggtggagcgtccattccgactgttgtggagcggacgcaccgcatcggcggtcggtgattcgctaatgccggtcacggtgacgttcaccgtgctgtccgtcggcggatccgccagtgatatcggattggttctggccaccacgatggtggcccgcatggtgcttctgatcttcggcggggttcttgccgaccggctaccgcggcggctgctgctcatgggcagcgacgtgttcctgttctgcgtgcagacggtagtcggaatccttctcctgcaaggccacaaaagcgtcgggatgctcctggtggcggcgctctgttatggcgcggcgtcggcgatctcgaagccggcactcatcggtatcgtgccgcagaccgtcagcaatgcgcggctgcagcaggcaaacgcgctcatggagctgtccaagagcggtgcggagatcctcggccccgccgtcgcgggtgccacggtcgccctggcctcgccggggtgggtttacctgctcgacgccgccacgttcctggtcagcgcggtgaccgtcatcggtctccaactcgcgcccatggcggacagggagccggagagcttcctcaagaacatcgtcggcggctggcgagagatggccgcgcgcacctggtactggggtgcggtgtgctgccacggggtgtggaacgtcggctcctgcgcgttctacgtgctggggccggccatcgtggcaacccagaccggcggtgccgcaagctggggtctcgtcagcgccagcatggctggtggcgccgtggtcggctcggcggtggcgctgcgagtccagccccggcggcccctcgtggcggcacatgtcgctctcctgctggtagtgctgcagttgtccgcactcatcggcccctctccgaccggtgtgatcatggcagcggggttcgtgagcgccgcgggcatcgcctacgccaacaatctgtggacgacctccgttcagcggttgattcccgagaaggtgctgtcgcgggtgaactcctacgactggctcgtctccttcgcggtggcgccgctggggtacggcgcagtcggaccgctctcggagaagatcggcaacgcggcgactctcgagatcgcgctcgtcatcgtcatcgccgccgccaccgcgatcatgttggtacccggcattcgggcactacagcagacccgaagcggcgcgttggagggatggcccgagctcgcggcgcgaggcgatgcctgacgggatgttccttcgcccggatgaggttcggacgggtcggcttcagcccacgggttctcccctccggcctctcgcggttcgctgtgtcacccgcggtggagtgggacgtggacggtctgtcggccgcaatgttccctcgggggaggggaatgccgttgcggaaggctgatgccgaggcgttgcgcggtatcgggcgggacgtggcgaaggccgccacgacgttgcaggaagcggcgaaggcggtcggctccggtctggtgcccgcgccgcgtcatggccggaattgcctgattgccaaccgtgaacgtgattctcacagggcttgccgcggaaacgagtgcgggcgggagcatttttcttgctcgggaaatccgctgcaaggcggcgggcgccggaacctcttaagtctgttttcatttgcgacggcaggttggtcggtcccagaagaaattgtgcgcgcaagcaattagccgtcgatggcgtgcgtccgtgccgcgagtgtctgttgtgaaggttgccacgatctatcgggatcgaccgccggcgaagctgtgtcggagacgcccaccgcgcctgaacgtcctgtcaggaaccgctgtgagctgctcatatgacgtcaaggcgcgacgacttctccggtttcgccggtccactgtgtaggatctgaggcgacagcatgttgcaatagatgatcttgacaggctgccgacctggtgatctaatctggatctattacggggttgcaacaacggggataacacgtttctgtgccattccgggtgtcgtcttcgccatacgacgggcgattttcgtgcacctgggatgccgtgcatagtcgcgtggaaagactgagcagttcggcattgtagagtgttcggcgctgagttttgcttccatcttcgtgtcgcgtatcccgacccaaggaaggaggcgatctacatgcgcaagtacaccaagcccgtggctaagaaggttgtgttcggcaccgttctctcgaacgtctgctgattgacgaggatatgccgcgtagtcgtatgcgcggcatatcctctccagttcttctggccgtcgcccgcacccgggcgcgggcccgacgtcacgtgaccacgagtctctcgtctcatcaatgtcgtacgccagtgagggaaacatgtgtggattggccggatgcgccgctctgggtggagcatcgctcggcggcgatgccgaggccctgctccagcggatgaccgcagcggtctcccatcgaggtccggacgggcgtgcgttccaccgctcggagtccgtcaatctggggttcacccggctctccctggtcgacccggtcggtggcggacagccgctgagcaccgacgacggatcactggtgctgatcgccaacggtgaggtctacaaccatcgtgagctgatcgccggcctgccgaccgggaccaagatgcgtaccggctcggactgtgaggtgctgctgcatctctaccgccgcgacgggctgaacttccttgacgccgtacgcggcatgttcgcggtggtgctctgggaccgcaaccggaatcggctgattttcgcgcgggaccgcttcggcatcaagccgctctactaccaccgcaaccaggaacggatcatcttcgcctccgagatcaaggcgctgttcgaggatccgtcctgtccccgcgagattgactggctgggcgcgctctccgaccagatgatgaccggtgccatggtgctggacgacagccagccgaggtcctggttcaaggagatcgaacttgctccggctgcctccatcgtcaccatcgacttgctcaccggcgacacgaagacccatcagtactggtcgttcccgaccttcgacggcgcccggaccggctcagaggccgaactgatcgaccgctaccgggatgccctcgcgtcctcggtggccgagtgcggtgtggcggacgtcgaggtcggcctgttcctcagcggcggcatcgactccgccgccgttgccgcgttcgcgcctgagaagcctcggacattcaccgccctcaacggcagcacgctgctcaacggggacgccgaatacggtgaccgcatcgcacgccacgtcggcctggtcaatcatcaggtgctcttcgacaccaccgtcacgcccagcgcggatgaatggaagcggctgctctggctgctcgagacgccgctggccgggcccgaagccttctacaagtatgagctctaccggtacgtcggcgcgtatgcgccggaaatcaaggcgatgctgctgggcggcggcgcggacgagttcaacggcggatactcggtgtccttcgcgggtggaggagactggaccgacttcgagtccaacgtccgccggatggagctgcgtacggcccagtggacccggcccgacctgggcacctggtgggagcagtcggaccggtcgctggtccgggagtccgtcctgcgtgacgccgccggcggaaccggccgggacgcctacgacatgttgttccgatggaagtaccgggacgtgcagcagtacaactgctggcacgaggaccgtacggccgcgggcaacggcatcgaggcccgggtcccgttcctcgatcaccggcttgtcgaactggtcgccgcggttccgaagcaactgcgcccggcgctcgtctgggacaaacaaatcttgcggcgcgccatggcgggcctgcttccgcaagacgtcgtcaaccggcccaaggttccgttcttctacggcgacggtgtgctgcacacctaccggacgttcgtccggatgctcgcgcagaacggtggcgtcctgctcgacgaggccttgagcggcgccggagccaggcaattcctcgacgcggacaacattcggacggctctgcacgggctgcagcaggatcccgcctcaggccacgtcgagtttctgctgcacgcggtgaaccttggtctgctggagcagatgacgcacagccttccggcccggcccgccgaggcggtcaccgcagcggtgcccgagagcatcaccgtccacgattgggacgagcagcggagctcgatcgaggaggcggtgcttcagcgcccggccatcgacgacgagacggttgtcggtctcgcggacggggcgctgctgctgcattcccccgacgacccggcgacctggtacgtagtcgtcgacggcgccatcgagtatgtgatcgacgaggatgacaacccgcactggccggctctgctccgtgcactgggcgaggagacaccgctgggtgtggtccgagagactctcggcatcaccctcgccgtcgcacgtgacctggtggtcgaaggtctggagtccggtgtgctcacgctgtccgccgaggtcgtgggatgaccgtcaccaacgtgcgcgctggtcgagtccgtcggccgtacgccacctcattcgatcgaccgggttggacgctggactcacggcggctcatcgccatgtcctgtgtggcggcgttcagtgtcggcttgtggagcgtcggcggcgactgggccagagtgatggccatcgtcgtgatcgtcgaggctctgctgatgtgtctgccgtggcgggtaccgcgcaccatgcgcagtggtgtgagcttctgggcggagacgctgtgcggtctcctcgccccgatcgtggcggtcaccatgacggtcgtcacccggccggcctggctgaccgcaggagccgactggtggtggttcggggccgccgttgcggtggcggccggactcatcgccctcagtgacctgcgtctgccgtcactgctgtccggagagttggccttcgtcttcggcccgacgccgcgggcacacggcgcggcgcgcgcgttcgccaccacggtctgcgcggtgggtgaggaggcggtgttccgggtgccggcgttgctggtcagcccagccgcgcccgtcggcctgctgggtgcgatcgcgttcgtcgcgaggcaccacattcagcccggcacgaaccggcgcggcacgatccgctcaaccatggtggagattgccgcgggagtgctgctcctcggtttgacagtggcgtccgggtcgatctatccggcgctcctcgcgcacattctcaacaacattcccaacgtgatcctggagcttcagcgggagaacgacgacaggggctggacatgatcatcgatcgcgagcacatcttggccgagatgaaggttcgtgccctggtgcccgacgactgcctcgctgttttcgcggtgggctcgatcgcccgcggctgggcaaatccgggcagcgacttcgacttcatcgcgatcaccgcgcggccgtggtcggtgcagggcgcccgaagtgttccggtgccgctggaacccaatgcggttcaggcgctggaactccaggtgggggagcgtcggtgggagatcgcctactggctcgacggacagatcgaccagatgttggccaaggcgagttggcaacagttcgacgccgggatctcctcgctgaaggtgctgaccgatcccgaggaactgctgttgggccgcttccccaccgcggtgccgctgctcggcgcggactggctcgaacgccgccgcgcgcagctcgcggagtcggcatacaaggcgttcatgaccacccgctcgcttgccgaggccgacggcaatgtggaggacgttttcgggatgctggccgcgggtgacgcgcacagcgccgtgctggcggcccgcaaggcgttcgggcacatcgttgatgccctactggagagcaacaacgacttcgcatcgcggtcaccgaagtggcgcgcccgccggatgcgcgacgccggcctgcccgttctcccgttcgagcggtactgggcggtcgagaccatggccgacttcgacgagcaggacccggcggcatgggccgcgcgggtcgcccacctgtgcaaagacctttccgtggagatcgagatctgatggctaccgccggcaccctcaccgcccagtccgttgtccagcgtgcctccggcgcccggtttcggaaattccgcggcaagctgttcgtcgccaacgcctcgctggccttcgagctggacgagatcgccgagttcatcttccggcaggtcgacggcgagtcgtcggtggaagcgatcggtgcgaaggtagccgccgagtacgacgtcgacgtggccgaagccgtcgccgacagcctcgaactactcagccagttggcccagaacgacatggtgcattccgtgtgaggggtggtcatcgcgccagatcgtcatgcgtccatcggggttagcgttcaggaggctcgtatgtgtggaaccgttggcctgttcatcggctgtgccgcgctgtcgtactgccccaaagaactgctgctacagaccgcacagcaggcggtcggcaacgagcccgaatatcgcagtccgtttcgcaactggcacgagcgcgcgagcgtccgtcaggcaccgcgtcgtctcctcaccgagggggccatccggccgtacttcccggccgaactcgtaccggtgacccgccatcccctgatcaaggggctggccccggaaaccttcgatgaggtgctcatccagcacctgtatcgatatctgaacttcaccgcacgcttggaatattcggtggtgaaccgcacggtcctcggcatcgcgtccggctcggtgggtgtcaccctgcccgaagagatgcggttcgacgcctacaagatgtactgcgacgaggcctaccacacgctcttctccgtcgacctcgcgcgccaggttcagcagcgttccggcgtggtcgcccggctaccggatgagccgtacttcatcgtccggctcaaacagctgatagcggaactccccgagcgtgatcgagcgcttgccgagctcttgttcgtcatcgtttccgagactctcatctcggcaacgttggcggacgttccggaatgggacggggtctccgcggcggtccgcggcacagttcgggaccacgccgccgatgagggccggcatcacgcctatttcgcggctttcctgagattcctctggggccagctgtcatccgacgatcgtcgtcgggcagccgtgctggtgccccggctgatcgacatcttcctcagaccggatgtgccggcgctgcgggcagagatggtcggctacgggctcaccgcggaggaggccgagtgtgtcgtcgatgaaacctacacgccggatgtcgtccgagagcacgtagcggcgacctcacgacaaaccgtccgttacttcgagtctctcggggcattcgacgacccgcttgccgcggacgaattgcaccgttacgggatggcatcttgaacccgtcgcagcccgggtgacaggccctgcggcggcagcagtgaaaggctgacattgaacacgtacaccgaccagctagcacttccgatcgaagtgcactgccacggtttcggccgggtggatttctccgagttcgccacacttgacctcgaagagctagaccgccagtgcgccgaggagggcgtgctgagcatcccgacgctttacctgcaccgggaccggttgaccgacttcgagcagttcatgcaccgctatcacgcgttgcgccgggccggtcggttgccccatgtcgcgggggtcgctctggaaggcccgctgctggccagccacggtggcacgccgaaggccacggtgtgggcgccgacccggcacgagtgggagcggctggcgaagctgggctcgctaggcctcgtctacaccgtcgtgtcgcccgatgccttcaccgcggcctccggtctctacgaggctctcgacgatcggcacccgcgcctggactggatcgtccccctgctcatggagcacggagttcgtcccgcactgggacacttcacccgggccgacgagctggccagcgccgaattggtacatgacatcgtggaaatggcctggcagagcgagtggaccgggcagggggcccgggtggtcaccgatcacctcttcaacgacatgccgttgcgcatccggcacgctttccggacctcggcggcccgcaaagtcagagacagtacgctcgccgcgtacgacctgccgaactggactttggcggacatgggcgagatcgccggcccggttcccgcggtgatcatgcgggaagcggccgcgggtcggctgtcggcctgtatcaatttcgatggcgagcacgtcgatctggcgatcgccacccgcgcggtcgaactgatgggttactccaacgcgatgatgatgaccgatcgctgcgactcggctcgcatcggcggccaggctctgcatcagaccgaggagaacggactgtggtaccaggacggcggtattgtcgccgcgggttcccagccgctcgccaagcagatgcgtaacgcgcaggtcaacggcatcagcgacgccgatctttggcagctcgccacgtcgaccgcgcaccgggcgttcggcaccggcgtgcggaccgacctggccgccctcagcgtcgattcgcagtgagctctgaccacgacaaggaattcggcatgcggggctgtcgcgccgctgtgcctgccattgacgaaacgcggaggaacgacggatgttggacgcgctgaatcgcctgacagtggactggtccgacctgcccaaggcgcggcagcagaccaaggagatcctcaccgccctggccgaggacaagaacgcgcttgaggagctgctggcccgggctcgggaggaggaagacctcttcgacaagtgcgagcaccatcggctgctcgacaagttggtgatctacgatgcgctggaccgcgggttccgcatccgggtccacgtctcgaccgaggaccaccgggaccggccgcacgaccaccgattctccttcacctcgctgattctgcgaggcaactaccggcacgtgcgtcacgagttggtgggcaacctgggagacgtgccgaacgacgttcaggacgacttcgacgcgcgcgagtccgacctgcgtgtggtcccgcgcttcgtgacgactgagcgggccggcaactgctacaccctgcaccacagcgagatccacaccacctacaccaccccgaagacggtgtcgctgttcctccggggtccggcggagaaggaacgctcgctgatcaccgaacgggagaccggccgggtgtggtggcggttcggcgaagaccaggagaaggcgtcgcgccggggaagtaaacggatcagcaagcagtacttcgatgacctgaccggccggctgcgagccatggaggtgctctgatgaccgaaacgatgacgagtggtgcggtgatcagtgcgcaggagcgggccgccgtggaattcatggcgtcgctgccgaccgtgcggtgggatgacatcgaggccgcggctgaggtgaccgagcggatcgcgcgtcgtctcggcgacgaccgggagatgctgggcgccctcgtcgaccgggtccgccggacgccggagctgcgtaagaagtgtgaatgccacgccctcgacgacaagattgtgatctgggacgatccggagaagggtctgcggatccggttgcggctggcgaataccaatcagtacgaacgggtgcacaatcaccggtacagcttcaccgcatacatcctgcgcggggcctaccagcacacgctgtacgcgaccgaccaaccgttggacgacaccgcggacgtcgaccggttctggccgcacttcatccgtgaggagccggcgggccgctgcatcacgctgcaccatgatcagctgcacaccacgatcaccgagcccgagaccatctcgctgatgatccaaagtccggctcagaagcgccgcgctttcatgatccggcgctcggacggtcacgtctggtggcgtgagggggccgccgacgaaacggcggagcggcgggccgaggttcagatgtcggacgagcgtttcgagcactgggtcactcggctgaaggcgttcggcgtgctgtgagcatcactcagaaggttctccgctacggcgactcgtcgtggcagcgcatcgacatctacgaaccgggtgacagcgcaccgcgctgccgggcggtactgatccacggtggtttctggcggcacgaccgcaccgcgctcgacctggagccactcgcgtgtgctctggtcgcccgcggatgcggcgtggcggtcctggagtaccgcccggtgtgggacggcggcgcgttcccggcctccgtgcaggattgcgtcgcggccatggccgcgctcgaggggagcgacgagcggtggcgggacgccgtcgtgaccggccactccgccggcgggcacctcgccctgagcgcgttggccggacgagccggaaagcgccgggtcgtgctgctcgctccggtgaccgatctggagtcggctgccgaactggaggtgggcgacggcgcgatcggccactttttggcgaagcatcatgctgtcggcggccgtaccgtcgaggcggttccggtgatcggatccgccgacgtcacggaactggtggtcgttcaggccgagaacgatcaagcggtcccgtccgcgctgatggaccgtcaggtcgcccggtggcggcacgacggtctgccggtgacccaccacctggtcgcgggggcccggcacatgcacctggtcaacccgcagcgaggcggtagcgatgtgaccatggccttgctgaccggcgccgagttgtcgacagggaatccgcggtgaccgatgccgtgacggttcgtacggtcgggttggatcaggcgacgactccgctccggatcggggtgctggtctcggcgaccggcgccaatctgcgcaccttgctggacatggcggcggctgacccggatacgtacgaggtggcgctggtcgcatcacacgcgccaggggtgcccgccatcgacgttgcccgcagcgccggagtaccggcgtggcccggcgacttcgacgactactgtgggctgtcctcccaggcgagcaccgacgcggaccgtgcgcggtaccgcactcgcgcacgggagtggcatgaccggctgaacgcacgcatcggcgcatgggaggccgtccacggacgcctggacctgatcgtcctggcttaccaccgatggatcgagggcgatctgcttcagcgtttcgccggccgcatgatcaatcagcatcccggggatctgagtctgctcggctccgccggcgagcggttgttgatcggcaaggacccggtgcgcctggccatgaaactcggacatcggtcgacgcgtacctcgtgcttcctggtcgacggcacccgcgacggcggcgccgtgctctgcctcgggccgtcggtacccgtggaagatcgtcgtcccacggcggccgaggcgcacgagcaggagatgcggcagaaagcggcgagcgatcaggtggcgctgcgctggaccgtacgggccatcgcagaaaagcgcctggcgatcgacacggccgcgacgcaccgggacggcagcccggtggtgctcatcgatggaacgcccacgccgctgggcggaaggagattcgggctatgagccacccggcgaccgagacggttcggcggtctgcggtgcccgccacggccctccaacggctgaccgtcgatgcggcgaaggatgcggcataccgccacgacacctacttccgggaggggctgtggtccttcgagcggcatgcccgcccggagcgccaccacgacgtcacgttcgtcgtgctcaagcccgacgccatcgccggccgtcgtggtgagcaggtactcggcattctgcgggagcgtggttgggcggcggtcgcggcgacgaccgtccgcttcgatcccctgctcacccgggagatctggcgttaccagttcaacgcggcatcggcccagcggatcgcggtcgtcgaccacctcctgggctccggcccgtcgttgctcgttctgctgtacgacaccagttccgcggacctgccggccagtgtgcgcctgacggcggcgaaggggtcggcggaaccgcgtgccgcccgtgagggcgacctgcgtacccggatcggccgggtcaacggcctgttcaacttcatgcacaccgccgatgagccggccgacgtggtgcgggaactacagctcttctcctaccaggcaggctgggactggtgccgggacgcactgcgggaccctgcggccgtactcgcctcggcgaatccggcagcgtcgatgcgtgcgctgctgaaccaggtgacgaccgaaattccggctcacgacctcgatctgccggccgcgctgcgccggctcgccgccggtcaggatcgatggtcggagctggcgctcgatcacgcacgcgtggacgaggtcgacctgtggctggctgagcttcgtcgcacgccgctgccctccggcaccggccgatgggacgtgttgaccgtgctgaccggctggatcgagtgcaacgagcccgatgtcgccgcgctgctggacacccctctgccagcacggtgggccgccatcaccggccaccggccggtcgacatgccgaggagtgcgagatgccccagctgaatgcgaccgtgccggtaccgccatttgtgggcaccgggaatctgatctatcggtcggcggtggtgccccgattcgtcggcgcggccggctgcttcctggaggctgaagacggccgccgatacctcgacgcggaggccgcgaacggcaccgctgcctggggatatgacaagtccctgttggctgaggcgttgctgcgctgcgccgagttgccggccctgccgtcattctgcgagtcgtcgctgcgagtgcgtgtcctgagccgcctggagcggctgttctccgaggtcatcggtgcacccggacgcgttgagctggaccttggtggggctcagggcatggagaccgcgctgcggatcgccttcagctcccggggacccggcacggtcatcgtcttcgaaggagcgttccacggccgctccggtgtgaccagcatgctcagctccagcccgcgctatcgtgagttgctggcggcctgggggctggaagtcgtccggctgccgagtccggactgccggagctgtccgcacaacatcacggcagactcctgcacgcccgggtgcatcacggcggtctcgcgatggggatcggagctgtccggcgtgggcggaccaggcttccggcggaaggcctcggcgttcatcttcgaggcggtccagaatgtcggtggcatggtccagccggatcccgtcctgctgcgagccgccgccgagcacgcccggagccagggtgccttggtcatcgctgacgagatcttcaccggcatgcaccgggtcgggccacgctggggctttcagctggccggcatcgagccggacatcgtggtcaccagcaagggactgaccaacggcgcggcggcactgagtgcggtgtgggctcgcgagccgctggcagacgcggcccactacccgccgggaagccactcgtccacctatgtcggcatcccgcatgcgctcgcggtggtcgacaccatgctcgaccgctgggaggcgtgggccgaggtcgagcacgacgtcgcgaacctggaattggccatgcgcggccgcctcgaggaactggcgaagcggcacccgtgggcgatcgatcaggtggacgccctcggcgcgaccgcgcgaatcgtgctcaccggaccccatgccgccgacctccggcgactgtgcggaacggtccaccctcagcacggcttgctggtggcctccacgggaatggctcccgacgtcatcaacatccacccgccgttggtgttcggcgctgccgaactggacctgatggccgaaatcctcgacctggccctcgacgcgttgcggaccgagggagagccggcatgaacgaaatggacgacccgctgatctgcatctgccagcaggtgagtgagaaggagatcgaagcggcactggctcagggccactgttcgcttgaggcgattcgcgcggcgaccggggccaacaccggatgtggcgactgcgcaccggatatcgaagagctgctgttggccgcgcgggccgatctgggacacgaagaggtgcggtgcacatgaccgacagtcagcccgttctggtgggcgcgatcctggagaacggcattcccctcgttctcgagccgaccgcagcgtccgaggcgctggtcgccgtcgtgtttccggtagcgggcgacgatcttgcggaacgggtggtcgctcagcaactggccgacgcgttccaccgggcggtccgggcggacgggtcatccggtgtcgtgctggctgacggacttctgaccgcgtggtgccggacaccgccggagcgggtagccgagatgctgccccgctttgccgacgcgctgctgcgaccagactgggacgcggaggcctgccgatcggccggcgccgcggctgcgaagaagccgcacgacacccgggaccgggcggtgaatcagctccggagcctgctgttccccgacaatctggccgccccgggcaacgctgggcagtgttgcgatctagaaaccctggttgaacggcaccagaaaatgctgacccgccggcccgtgatcgtggcctctggtccgtcggtggcgctggacgcgctccccgcggcactcggccttctcggcgagccgcgacagttcggccacggacccggccgggccccggggtgggcggcggtgtccgtcggtggcgtgaacctgggatccgggaccggcgacactcccacctggctggtgctcggcgcccgcagcgtcgacgccgaaggagtccggccggatgcgttgatcgtgcttgccgagctcttcggctccggtccggcatcgctgctgcggcggacgttgaccgacatcggcatcaccggccagctccacagtgcctacgttgccggcgatgcgccctggtggtacgtcgcgctggaagtcccggccggccaggtcgccgagctggagtcgatcgttcgggagaccttcgaggtcatcatcgatcggcgcctgtccgaatccgccttcgaggcggcgcgccgggccgcatgggctccccggccggaccacgtccgcgaactcacccgcctgattcatcgggccgccgccgagctggaccagccgggcgctgctgcggcgccaaccccggaaacgctgaccgcgcacgatgtcgcggtggcggcccgccgggtcctggccggctacgccgttaccgtcgcctgacattgaggagtgttggatggaccgcgttcttgaccgcctgcagagacttgactggtcacggatcgaggttgccgaacgggttgccggtcaggtcaccgatgtcgtcacgactccgggcgcgttacgcgaactgatcgacaatgcgctcggcgacaaagatctgctgaccatgtcagaatgtcaatggtggggcgaccgcattgtgttgttcgacgacccggacagcatggttcgcattcgtttgcatcgtttcgaccagggtacccattttccgcacagtcaccgttggccctttcacacgaaagtgttgaaaggcaagtacattcatcgcctttacggtcctgaatcgtatgtcaggcagcaggtggaatccggggtgaccacgctgacgcccagcacgatccgtacggagaccgaaggctgctcctatgcgatcgatcagcacatggtgcattcagtgacgtcggcgacaaatacgttttccttggtggtgcaggggccacggctcaaggaacagtcgttgcgtacggcgcaggacgggtcgctcatctggaagggcggccgggcgaccgagaccacagccgcggtgaagcaggtattgatgggcgcggaccggctgcaggaggttcgcgagctggcgctccgttccggactgatcgacaagtaggcgagatggactgaagccgtggcggcccgatggccgccacggcttcatctgtcagaacagcggttatccgacgctcgccatgaccacccgggcgtcaccggtcacggtgaccgcaccatcgcgggccgccacaaagcagctctcgccgcgatggagctccacggagtcaccggcggcgacacgcacgaccgcccggccctcgagacacagcaggatgcgcgggccaatggcggacggctcgctccggccgccgcgcggctcgatcacgtacaggcggaattccggcgccgggacgtcgtacgcggtcacgcccggactcaccgtggtcgcctgaacctgcggaatcggcacgctgggctgggcgatccgggccagctcggccacgtcgatgtgcttaccggtcagcccggcgcgtaggacattgtcggagttcgccagcacttccacgccgacacccttgagataggcgtgcaccccgccggccggcatgtagagggccgcacccggcggcaactccacgtactccagcaggagcccggcgaccagaccgaggtcgccgggatggtccacggccacctgcgccatcgccgcgcacgccggcgcgtatcggccgccgcccgcggcgacccgcccaaaagccgccaccaccgcgtcgagcagggcggctcgctcctcagtcggccaggtgaggatccgcacgagtgcatcgctgcgggcatcgccggccgggctctgccgaagcgtctcagcgatcggcgcgagctggggcacgcccagttcatcgagcagggcggcggcgtccggcgcggaccggaaaccagccagtgcctggaacggcgtcagggagtagacgatctcgggtttgggccagtcgtcgacataggtgcgggtcgacgtcgcgccggcgaggatcctctcattctcctcccggaatccggcctcggcctgctggcggtccgggtgcacctgaatcgacagggccttttccgccgcgatcaccttgagcaggaagggcagccgggggccgaattgtttgaccgccgactcaccgatctcaccttccgggtcggcggccacgaccttttccaaatcagtgaccgcgccgtcgcgatcgaggcccgatggaccaccgggatgcgcacccatccataattccgcttccgggcccaggctcggggtcgaccggccctgaagctcggcgacagcgtatcgcgaaccccactcatacggcttcacgactggcttgagaagatccatgtgcgtatcctaataactcgtcaaaaccaggttaggcgaggtcacgctttccgcgcagcgaactgccccacaacaccgccggggtgaggaaggccgcgcccacgatgacccagagcgcctcccggttaccgaacgaggtggcgagcacgcccgcggtcaccgcaccgaccgggaccgcaccccaggagatgaaacggaccgtcgccatgacccgggccagcaactcgggcggcgtggttgcctgccgatgggtccgggtgaggatgctgaggacgacgatcccgatcgcgaatccgatgttgccgacggcgaagagcaccagtccccacttggcggtggcaagcggcaggaggagcgcgaaacaggcaccgaccagagtggcccaccggatcgccggcgaactgccgagcaccttggacagccgggtcgtcacggcggcgccgatcaggctgccgaccccttccgcggcgaagagcaggcccaccacaccgaccggcgcccccagcgtccggaccagaaacaccggggtgagagccatcaacccgcccgcgacaaagttgatcgtcgtggcggcggccacgcatggccggacgacctcgtgatggacgacgtaccgccagccgtccctgatcattcgcccggcggacgcgttgcgggtgacgggcgctgccgcctgcgggcggggcaggctcgccaggagcaccgccgacgcgaggtagctgatgacgtcgaccaccaagctggtcaccgcacccagaagctgcaccaggatgccgccgagggacgggccggccacctgggtcaccgcctgggaaccggaggtgaggctgttgcgggaggtgagttcctccttggtcacgatggccgggaggaaggtggagttgccgacatcgaagatgacgcccgcaaaactgatcaccaaggccaccgcgacgacctgtgccagggtgagtatcccggccagatgtgcgagcgggatggatagcagtgcggcggcccgggcgacatccatggcgatctgcgtgccgcgcagcgggaatcgatgcacgatgacaccagcgggcagtccgatcacgatccaggcgatgaagctggcggcggtgatcaggctgatctcgaacgtcgaagcgtgcagcacctgcaccgcgaccagtggcaacgccatcgcggtaaccgcatcgccggccgaactgaccgttgatgccgtccaatagcgccaaaacagactggattgtcgtccgccgaccggtgtggtcttctcatcggtcgaagtcatggacaagcctccacaaatgcgtgtcaggtcgatggatgtggatcaccatacacaccgatagacggcggccggtccatcgaatcgggctacccggcggcggctccttccgcgggcgtacggtccgctcgggcgagggtggcgtacgggtggagcgttacggtggtgtgggcggtgtccacactggtgggctcccgggggaggtggcaggactcgtgccggtggtggaggcgtcggtggtcgccgggatggtgatcgcgtgggcggtgcgcaaggctcgtaaggctgctggccgcgcggatgagacggtggacgcggcgatcgacgcgggcgcgggccggttgcatgatcttgtcttgtcgcggcttggtggtccggtgcaggaggatttggccgaggaagcggcgagtgagtcggggcaggtcagtgagttgactcggcagcaggtcgagttggcggtggctgcggcggcgcgccgggacgagacgttcgccgagacggtgactgatctgttggagcagctgcgtcaggcggaccgggcggcgggtacgcacatttcggcggcgccggggtcggcggtgttcatcggtgacgtgaccgcgaccgcgtacgacgatgcgacggcgatcgggcaggccggcaccgtgaacatcggtgatcggctcggggagcggccggaccctacccagccgggtccgtccggccactgaccgggctcggtgacggtggcgccctgaccggggcgccggggtggcgcagcatgccgggagcgggagtgctcgggcatggtcagcagggcggggtcagggtcggtacggccacgacggtgaacgtgttcctgtccgcggcaggcccgttggtgacagcacggtcggcgtatctggcgcagttgcgccggatcgcgccgccggtgttggagggccgcgaagccgagttggcggaactggcccggttctgcgtggagcctgggcggggttcgtatgtgtggtggcaggcggacgcgtgggcaggcaagtcggcgttgttgtcgacattcgtgctcaatccgccggatgagctcagtgcgcgggtgcaggtggtggccttcttcatcaccgcccggctggccgggcaggacacgcgggaggcgttcgttgcggcggtgaccgagcagatgggcgggttgaccggccggcagccgccgaccgtgcccgacgaggggctacgggaggcgtggctgctggatctgctcgaccaggccgccgctgcctgcaccgcgcggggggtgcgcctggtgttgctggtcgacggcctggatgaggaccgcagcagcgccgccggcgtccacgcgcacagcatcgccgggctattgcccggcgacccgccggcggggatgcgggtgatcgtggcggggcggccgaacccgccggtgcccgacgacgtgccggactggcacccgctgcgggatcccggcatcgtgcgccggctgtccccgtcgcagcatgcacgcgatctgcggcggctcggccaggcagaactcaaacgcctgatcaaaggcaccgcagtcgagcaggacctgctcggcctgctcaccgcggcgcgtggtggcctgtccgggcccgatctgcgggagttgaccggcgccgggctggccgagatcgaggacgtgttgcacaccgtggccgggcggaccttcacccgccgcaccgccgaatgggatcccgacagcggacccgaggtgtatctgctcggccacgaggaactgcagcatgccgctaccgcctacctcggcgaaccccggctggccggctaccgtgcccgcctgcacgcctgggccgacacctaccgcaccaccaccaccaccgacggccgcccgccgtggccggcaggcaccccggaatacctgctgcgcggctaccctcgcatgctgaccaccaccggggatgtgccgagactggtcgcgttggccaccgatccggagcgccacgaccggatgcgggatgtcagtggcggcgacaacgccgctttgaccgagctggctgcggccgccgcgctgctgcgacgggaggcccatcccgatctgcgtgcgttgctgcgcctggccgtgcaccgcgaccgcctgctccgccgcaacgagcggatgccggatgagctcccagcagtgtgggcggcgctcggcaaccgcaaccgcgccgaggcgctggcccgcgcgatcctccgtagcgaccgcggcgcggacgaggccctgaccctgctggcggaggaggtcgcgcggaacggcgactacgacgaggcacggcagctcgtggcagagacccatctgtacgcacgcgccggagcgttctgccgcttggccatgctggcccatacgggcggaggcgacgagcagcccgaggggctgttggcggccgccgagagggccgccgcggctgtgacgaccgacgtggaggttcgcagtttcgcgttcgggcacgtcgcggtcgtgcgcgccgcagtcggcgacctcgccggcgcgctcgagacgatcgacaggatcgaagtcctggatcgcggcttcggtgaagtactgattcgcgtcgcggagctcgccgcggccatggacgacgagccggccgtccgcgcgatcgtcgattactggcgaccggacggcttcgaagacccgccgcagtggttgctcgcgcagtcggtgatgctggcggagctggtcggtgatctcgagcgagccgaggccaaatcagccctgatcacgtcggagacaagccggtgtgcggcacttgcgttccgggtacgcgcggccgaggctcagcttgccgcggactacgcccgctcggcgggggacatcgctctgtcagcgccggacgagaatcgcgtcacggcgcaactccacgtcgtgcgcgcctggatcgcggcacgggacctcgaggcgagcgtccagacgctgcacgagatgtcggtccgcgaggaccaccattttcctgatcgatccgcactcgagcgtgcccttgaggcggtcgcggaacaggcgttggcgaacggcgaggtggagctggcggcgggcctcgcggtggtcgccgcggagcgtggtctgcgccgggcgaacgctgacatgatcctgatccgtgccctcgtggaccacggggagttgtcacgggccgagcgcatcgcgcgggcgggcacggacttcgcggcgaacgcgaacgccttggcggtcgtcgcatacgcccgcgcccgcgcgggcgaccacgaacgggcggccgaaatcgccatcgagatcgagcagtcggtccgcaccgccgccggcctcgattcgccggtcgcgctcgccgaactcgccctcgtcctgctgaaaacgggctcacacgagcatgtcggccggcttgtcgcacagatcctcggcggcatcatgtccgatgcgcaggacgactacgaccgcgaactggtggcggtgagacttgtcggcgaactggttcggtgcgagcggttcgccgaggcgcaggcgctgacgaacgcgctggacccggacggcgactcgtggatcaccgacgtgtacacctacgcccggcgcaacgacggtcaacgcgggcaggtcatcgccgagccggaggctgcggagccggtcgaggtccgtatcggcgtgtcgatccagggaagcagtgaccaagagatccgcgacctgttcgaggcggcggagcgaagggagcggccgtactacacggcggccttggccgaggccggacgcgtcgaactcgcggagtcgctggccctcggtctcgacgatctcaacgagcggaccggggcgctggcgccgatcgtgcggccggcctgcgagcgtggcgacgtcgaactcgccgaacgggtcagcttggcgatcccgcaggaccatgagcgcgcgaaggcactggcgacgatcgctgggcaggtgccggacgataaggagcgggcggatcgcgcggaggcggaagcgcgcggcgtgcgatttgcggaggaacggtccgaggcgctggcggcgttctcggccgcgatgttcgccgtcggcgacgtcgaccgggcgctgtcggtcgcccgcagcatcgaccgtccgcccgaacgggccaaggctctcctggcgatcgcagatcagctgtcgccaccggcccggcggcgattgatcgcggaggcgctgtccttcgccgcctgggacgtcgtcctaccgtggctcgtcgcgcatgagccggctgcgttggacgtcgtggtcgaggagctcggcgtgaccggcgacgcctgatcggcagcgctggcggggtttgccggtcagcctgaagcgcttccccggtcatcaccgaagtgccggcagtcacgccggcgacgccgcgcccggcaccggggcggccgcgctacggcagaaccgatcagccggccggcgtgcgtccgccggcgtcaaccgacctcgaaggggacgtccgcaccgaccggccggcccccgactccggctcgggcggctactcccgacccggccacccggtacgggctcaggtccgccgcccggcggggaagttggacgtcggcccggctcgggaaggggtcgccggtcgacacccgggtacccaccggcccgacgttcgtgaagagattgtggtcggcggtcacttggagacccggaccgtcaaggccgagcgacggccgctgggcggcactgcgcgagaggaagatgttgtcccgcagggtgatcgaggacttcctcgtatcgcccaggttgaaaatgcgaatcttcgagatgaccgtgttgccggtgaaggtggcattctccatgccctgtggcatccagaagacgccaggcccgctggcgccgtcgatgacgttgttctcgatccggaagcgttgcgagatgtcgcggccttcctcgctgtagagggtgtacagcccgcagtagacgtagttgtcgtggaagtagagaccgttcatgccggcttcgacggcgtacatgttgcgccggctgtcacagggcaggtcgaaaaaggagttcgagacctcgaacgttgagtcgaatgatcccagctgtcccagggagagcggcgcgttgatgcgtagccgggtcattttcgtgccgatcgagcggacgttccagaactccgcgccgagcgtgttccatttggcgcaccgggcttgactgacggcgatgtcgatgtcggcccacaccacgttggtcatcgtgacgcgactgttgcgcagatcgccgctggtgttgccggctccgtcgtcgatgggcgacgccttgatgccgtagccgatgttgtccctggctgtcaggttggtgatcgtcgtgtcggtcaggttgccgaccgtgaagttgccggagcaaccgttgccccggtcttcggcgttgttgttcaaggtcagatcgtggaacttcgacccgacgatgtccgccagcttgatgccgttggcgcgaaaattctggaccgtcaggtgatggacatccagaccgtacaggcgattgagccatagccccgtttcggccgggccgcgttgcgtggccgagacgcccccgcgcaacgcgaaccgggcgatctgctgccggttggtcctctcggtggcattctgcacccggatcagaatcggggcgctgccggtgatcgtcgatcctccggcattctgccccgcaccgatcaggcttgcccccttggcgaggtcacacgtcttgtcacccaggtcgtaagcccctgctgcgaggcgcagagtgccgttcaccggcaccgcggcacaggcctgggacagggagttgaaggggcggccgaaggaaccgttcccgccgttcggcgccttggcggacacatagcgggtcagtggcgagtcggcggggctgctgacgggtggcgcggacaccgacccgaccggcgacgggcccaagctggtcgtcggtgctgccacgaccgtctgcgacgtggtgctctcccggggcgcgggggcctgcgcccgggagtacgcgtacaccgaactcaatgtcaggatggttgccgtggcggccgccacggcggcgggcttaccggcaagcaccttgcccacgtggcccggcttggggcgggcaccgatggaagccttcgaagcggccatctgcgccgtcgcggtgccgaccgcgtcggcgagggccggcggcgctaccagcaacggaaccccactgagcagccggtcggccggcaccaaaccgtgccgggcgcgaccgcagccctcacactcatcaaggtgccgggccagtcgcttgcgccacagcggcgctgcggttccgttccagccggccgccacgtcggccaatacggcgcacccgtgtgcggtgccttggagccgaaggacacgaatgatggcacgggacaggtccaagcgttcccgtagccgctgcagccggacccgcaggtggccaggggcgagctcggcagccgcggcaagctgttcgcgatcgagctcacctgccagttccaaccaccagagagcgagcagatcccgatcgtcagagtccagccagccggtcgcctcggcgatctcgcggcgctgttcgctcagtgccatccgggccaggatccgcctctcctggtcaaccgtatccgcgacgccctcgatgtcctcgtccaccgactggtcgaactcccagctgtgcatgcaatggcgccggttgctctcgcgtaccgcgatggccagaacccaggaccggaacctggccgggtcctgcacggagctgatgtggcgaacggcccggagaaacgtctcctgcacgacgtcgtccgcatcgggccctgaggttcgccggcgcacgaccgaatacaccacgggcaggcaccggcggatcagttcgctgagcgcggcacggtcgccacgcttcgccgcctcggcgagggtggcctcgtcggccgcccttacggctcgttgttccaccggttaagccccttctgtagcgccagcagggcctgtgtctcagcccgtcgccaagtggaccctgccgacggcggcgcgtaacacaaatccgatctgcgctgtgcaggacaccctgtcgtcgaaacgccgttcatggtcgacctggccgcctaccgcacctcgtacgctccgcgatccactggtcgagtccgaggcatgcggtccgcgtcgatgccgggagcagccttcgcggtaccgctgtcgatggccggatcgcccgcgcgcagccggaagtcgccgtccgccgcatcccgaaaatgcggagccgacgtcagcaggttcggatccggcggggtggagcgactgccggcaagcagattgtggtcgaacgagacccgggaggagccggacacctcggcggcggggacaccccggcccgcgaccacgatgttgttgaccacacgaacgtcgtcggcgagggtgatcgcaagatcggtggtgatggccggatgggtggcgtcgtggtagagagtgttgttcacgatgtctatgtgggcacccttgaagacattgatgccgcgtccgccgttgttgtaggaaacgttgttctccaccaggacccggccggtgtaaggagcttggaacagcggtgcgccgtgcacgtcctcgttggtcaatgactcgatgatgatgccgttgccgtcggtgattttgcgggtggtgccgctgcataggcatgggacgaggttctgattttccgaactcacgtttccccgtacgaccatcttcacatcggtccggccgtcggagttccagaggttcgagaacgagatcccgctgccgccgtacggtgagtaccagccgttacggcgggtcacgttgtacgccgctgtcacatggtcggcgtactgcacggagatcccggccagggtgcagtcggtgagagtgttaccccataccaccacgtgcgtgggccgccggggcggatccgcgcgggcctgctcggtgaccgcgatgcaactgttggacacggccggatcggagacgtcaccgttcttcgccgccgcgatctgttgcggactcagtttcgcgcgcatcccggtcaccgtgaggccggcgacggtgatgtaggaggcgtgtacccagatgccctgccactgcgcggcgtggaccaccgggtgggcaccggggaacgcagcccaggtgatccaccggtccggcgtaccggagcgctcgatcgtcaccacgctgttgcggcccgggtcgctgtactcgccgtcgtcgaccagcaccgtgtcacccggctcggtcagctcgccggcccggcgcagcgtccgcagtgcctcgtcacgtgtccgacccgagttgccgtcgtcgccccgacccgagacgtagaggtagcggccaccgtcggtgggcggcagctgtcgcgccgaccaggagggcccaccggaaccggcacccgcgccaatggccaccgtcgatgtcggggccggcggcgacggcgagggaccggccgagtgggccggtgccgaggtggccggcggcggtgcggtgacgaccacgggcgccggcgaacggtcgacgacgaacagacccaccgccagcgcgacggcgagtacagccgcggcggcgacgacaccgcgccgtccgcgtccgcggtgctgcggcccgtcagccgaggacggcaccatctcgtgaccggcgacgatcgtgtcgaacaggcgctcgggcggcaccagcaacggcacggtgagcagcagccgctccggcggcaacaaggccgggaagggcgcgccacaccgagcacaatcgtcgacgtgcctggtcagccgtttgcgccagacaggcgcagggctgccgtcccaacccttgacgagggcccgcaaatcgtcgcacttgtgcggtgtgtccagcgcggcgaccgcctcggcgatcaggcggccggcatgcagccgggtacgcaatcgttgcagccggacgcgggcatgggccgcggagatgcccagcgctgaggccatctcagcgctcgacatcgtgccgacctgcgtcagccaccacaggcccagcagttcccggtcatccgggtcgagccaggaggtggcggcggtgagcatgcggcgctgccgggcgacgtccacccggtgtaccacgtggtcctcgacgccggcctcgacggcgaccaggtcatcggtgtcggcgaaggtgatccgctgctgatcggcgccgagccgattgccgcgacgccgggtctcgcgtaccgcgatggctaccagccaggaccggaagctgttggggtcgcgcagaccgggcaggccggccaccgctcggatcatggtctcctgggtgacgtcatcggcatcagcccgggggagcgtacgggcggcgatgttgaagaccaggcccagatgatcacgtatcagccggtcgagcgccgactggtcgccaccccgtgccgccaggatcagatcagcggcgacgcttggcggggtcaacggcgtactcccttcagaacgaccgggtggaatcgtcaccgtgccgtcggcggcatgtgcgggccaacctgaccatgagccatcccgtcgtcgccgtgctgtcgtcgccctgcccgggactgaccgatcgtgttgatgatctttcatacggcacggcagggcagccggttcaccgctgtggcggtaccggaagcaggttccggcgggtccaccatcatcttctggacctccgtccagctgcgggcggcgtgatcggtccaggctttgagcaagcgacccgccgtcgtcaaccgcaccacccgggtactgcggtcgagcagccgagctccgacgctctgctccagccgacgtatccgtaccgacagggccggctgggtgatgctcaggcgggctgccgcgcgagtgaagttgagctccgcggcgagcctctggaaggccatcagatcgccccagttcagcgcgacatgctcgggctcgccaccatccggtcgcatcacagttctcccttccgccagcacgaggtactggactttgcggcggagacccgtgggggtcagcgggggtaacaggattcgaggaaatttctgccccgctctcgaggagcacgcggaccacgacgcgacccggcgagccagtcgcgcgccgtgcatctccggagacctcaccgaacgggtcggcgtaacacgaaatccggagcggaatatttttcgtagaaaatcgcaaacgtcgattcataagcaattcgatattactgcggcatcagcacctggagatcgagctctttcacccttaagttttcttgaaatgactgatgcgggttcgcattagaaaggtgctgtggctagtttgggggagccgccgaacgaatcctggcgagcattctgtgaacgaacaatccctcggagtagtcgtgcctcagtccttgcatgtcgcctggcccgccgccgggtcgcgccgccgccggacacttctcatcgccgtttccgccgcggtcactgtcgcggcagtcggcgtcaccgcccgtatcggagccttcgccgacgacaaaccggcgatccgcgatctgaccctgctcgacgccgtcggcaatcgaccggtgtccggccggaagccgctgagcggtgatgagaccgtggacctggcggcgttgggcacccgcgagctgagtgttcaagcgaatcccgtggggaaggtcggcagtattcggttccaggtcgacggccggaccaccagggtcgagaatcaccagccatacctgctcagcggggacgccgagaacggtaaggacgtcctcccgtggacgcccgccgccggcaagcacaccgtggtggtcactccgtacagccgcgccgacggcaaggggaccaccggggtcccgatccggatcaccctcaccgtgatcgactccgcgggcaccggagcgccggcgcgatcggccgggcgcaccgccggagcgggaatcggtggacctacgtgggcggccggcactctcgcacctacccagggcggccgtcatctgtacgtcagcgccaccggcgacgacaagcagtcgggtctcaccgccgccaccgccctgcgcactctgcagcgagcagccgacatgacccggccgggcgacaccgtggtgatcggcaacggaacctactccgcccccggaagacagttcgttctcggcatcaggcactccggcacgccggacaaatggatcacgtacgcgagtgcgccgggagccgatccgcggatcgaggccgccggctggcaaggcgtcgccgtgaacgcccggtacatcatcgtcaccgggctcaccgtgcacggtgccacggaccggctgaccgcaaaacagaaagacgcggcccgcaacggcgacgagaaagacccgatgatcaacaccagctgcatcgccgtgtccgagccgttcggcggcggcgagtcgacgtacccacaccacgtgcgcatccacggcaacaccgtctacggctgcccgctcgtcggcatcagtgccatgcactccgactacgtccaggtgacgaataatctgagcttcggcaacagcaactggtcgccgttcggcggcagcggcatctccctcttcgaggcctggaacagcgacggcaccaccggcgccaagctcgtcgtccacggcaacgtggtgcgggacaatgcctcgttcgtgaagtgtggctgcagcggcttcaagaccatcacagacggcggcggcatcatcgtcgactcgttcgacaaccgggacgccaggatcaaaactccgtaccaaggccgcaccttggtggagaacaacctgtcctatgacaatggcgcccgtgggatcaacgtcttccgcagcgcccacgtcgacgtcgtcaacaacaccgtctaccacaacggcgcacagccgtcgatccaggacaacatgagcgttatccgggccaccgacgtacgtgtcaccaacaacatcctggtcagccggggcgctgtcaccgcggccacccgatcggcggtcaccgacgtgactttcgactccaacctcatcgtcggcacaagcaccgtcagcgacccgcaccggcgcaccggcgaccctcagttcgtcgacccggccaacggcgacttccgactcgagagcgccagccccgccatcaactccgcggtgggcttccccgtcgcgccggtggacgccaccggagcggcgcgcaccggcaaacgggatctgggagctttggagacccattgatcgcgatcccggagattccggtggcccggccgtaggaccggaccaccgcgtcctgaatcgatgggtggcgccacagtggcggccatcatggtcttgtccgcagccggaggtcctgcggcggcgtacgcggccgtcggtgcgatcggcgccggcgcgacggccgcagtgggcgtctacttccgcaagaattgatccgggtacggaaaaccgcttgccggggccgggtggacgtgcgacggttcgctgccgttcgcgcccaccggccgggcggcgggtccgtaccccctcacgacagggcatgacaccacagatgagcatttccacgatcgacaccgaggatgccgaccgctgccggcgcgcgctcgccgaggagcaggccgccagcctcgccgcgaccgccaactgggcgcacgtcgacaaggaccgggtccatcgcgactggcacgacctgtacggcgagatcgccgccgccatcaccgcaggcgcccagccgcgggacgaggcggtccaggaactgatcgcccggcaccacgccgtcgtcagccggttctacacccccagcatggacgcctacctcgggatggcactgctctacgccgaggatgaggacatgcgcacctggcacacctcctaccacccccggatggtcgagttcctcggcgcggcgatccggcactacaccgacacgcgccgctgatccgatgcggcgtcgtcgcttccggggtgggaagctccgggcggcgtcctcttgaggatcggatggggcaggacctggcgtacctggttcggtgtcctgccatcagcgtcggccagaacaccgccacctgtgccgatgatccgtcggcgcgtaccgtgatggacggatccggcgagggccgaaaggacgccgctcggagggaatcgtgttcgcggacagccgccgggcgagtcccacgcgcaggatttccgggaccgcgctgcagaaacgacgaagccgcctgatcacggctgccggggttgctgacgctgtcatgaccagagccaccgggccgggagagaggcgggggactgtgctggatcggttgtccgtgcgccgcaccgtggtggtgtacgggccgcgcgccgcggaccacgtgtgggacagctacgtacggccgcagcgctggccggagtggtcgccgcagatccggtcggtggattaccccgccgagacactccgcccgcacaccggcggcgtcgtgcacgggccggtcgggctccgggccggattccggatcaccggcgtcgacccggccggtccggtgcgcagctggacgtggtcggtgtcgatgctcggcgtccggctcgttctgcggcacaccgtcgagccggtcgccggcggcacccggaccgggctcaccgtggacggacccgctccgctggtgatcggttacctgccggtcgcccggtcggcgctgcgtcgcctggtcagccgggaccggtgatggcgcaacggcgatacaactgcgggtgcggcaagaagcggtaccgcgacgagccggccgcgctggccgccgcggccgccgacgagcgggcccatcaggtcccggccaccacctaccggtgccccggcggactcgcctggcatgtgaccgcgcacggtttcctgccggaggcgttgcggtcggtggggcggcggctggcgtacgaactggccgagcacggccgggtcgacctggacgacttcggcacgcgggtgcttcggctggacacgcgcccggaccagcggcagcgcgaccgggtccggcagtgcgcggaacagatggccgggctcggcctggcccggccggacgacggcaggccggcgccgggcagtcacctggtggccgtgaacctgcccgggttgcgccgggtcgttcaggtcggactcgacgcgtaccggcaggagcggaccccgcccgggcaaccctgagccccaccgttccggtcgccttggcgacgacggacaaccaggtcctgcaccggtgtccatgaatggcgatgcgttcagctcgccgccggcggcgtggcgcttccgggctgcctcagcaaccaaccgccgtagccgacgaagaccaggaccacggcggcctgccaccacaggggcgccgcccccgggctgcgcaactggaagaagtcgtccatggcgtgcagcaccaccaacggccagatcgaacccaggtgccagcgcagcgcggcataggcgaagccgaatgccgtggtggtcaccacctggacgaccgagtcatcccagggccggctgaaccacaccgcgctcagcgcgtggccgaggccgaacagcacagcgacgcccaccgtggcgcgggtccggccgagcggccacagcatgcgctgcaccaccccgcggctgagcatctcctcgctgaccccgacggccaggcacagcgacgcggtggcggcgtaccgcgccgcaccgccggtgagtccgggagcggcataggtcaggttcaccagcaggaccggcaccgtcagccggaggcgacgggtcaccggccggccgaggccggcctgccgccaccagcgcagcagcgccaccgcggccaggggcaccccggccgcgacgaggttcgcgacggtcgcgacgaggtcggccgacggctccggcacggtgcggggcagcacttgcaccgcggcgtagagcgccgcgtgccacagcaccgtcaccaccacggcggagaggaccggatgagcgcgcacgacagccttcacatcgagaatcatggatcacctcagctgcctccggtatatccctgcgggcgcattcctccctgcccccatgcctacgggcagagggacgcctggtcctcggcggcgatgacgacggggcccggcaaccgacacgctgtcgtcgaacccgtcgatcaggaggacacgtgagatcacatcaggggaagcggcgtctgcttttgctcgcatcggtcgtcgcgctgaccgcgagtctgctcgccggcacgcccggcgccgccgcaccggccggtcactccgcccaggccactctggacagcgtgctggccgctcaatatgccaagtcgccactggtgccgggaatcggcgcccgggtcgacgcgccgggcctgcactggacggcggcggtcggccacgacgatcgggcggccggcaccccgctgcgcaccgacgtcaccttccggatcgcctcggtcaccaagaccttcaccgcggcggccgtcctcgctctggccgaccggcaccggctggacctcgacgcacccgtcgccaggtatctgccccgcccgtatccgcagctgctgcgccgcgggggctaccgcccggacctgatcacggtgcggcacctgctcgcccacaccagcggcctctacgactacggcgaggacgccggctaccaggaggccgtgctgagcgacctgcaccgccactggaccccggccgagcagatccgatgggcgatggaccacggcgcaccgtacggccgcccgggcgagcgttaccactacgcggacaccggctacgttctcctggcccgcatcatcgagtccgtcaccggcatggctcaggccaccgcgtaccgccacctgctgcccttctcccggctcggcctgacggcgacctggttcgagacgctggagccggcccccggccacgctgcggaccggcgcgagcaccagtactacatcgaccccacctccggcaccgccctggacgcctactccgccgacccgtccttcgacctgtacggcggtggcgggctggtctccagcctggcggatctcgaccgtttctaccgcgggctgctggagggccgggtcatcagccggtcctcgctggccaccatgctggccgtcacgccgggcgctgagggtgaccgggcgggcatgggcatcttctcccgcaccctcgacggcgtcacctgctggtggcacaacgggttctggggcgccgccgcactgtactgcccgcgataccggctggccgtgtccgtcaccaccggcgccttcgtcgccgatcccgagcacgcgacacccggcgccatcaccgacgcggccgccctcgcggacgcggcgatcggcctgctgcgggccaagggctgaccgacggaccgcgcttcgccgtcaccgcagcggcaccaggccgccgcgataggccaggacgaccagctggacgcggtcacgggcgtccagtttggtcagcaggcttccgacgtgtgtcttcgcggtgcccgccgtgatgtgcaggcgggccccgatctcggcgttggacaagccctcagcgaccagcgccagcacctgtcgttcccggccggtgaccgcagcccacccgggcgggaccccggcgcccggcgccaccgggccgggccgggccgcgaactcggcgatgaggcggcgggtgacaccgggagcgagcagcgcgtcgcccgccgcgaccacgcggatggccgtgtgcaggtcagccggcgcggtgtccttgagaaggaagccgctggcacccgcccggagcgcggcgtacacgtactcgtcgaggtcgaaggtggtcagcaccagcacccgcgcgggggtgtccccggtgatgacgcgcgtggcctcgatcccgtccagctccggcatccggatgtccatcagcacgacgtccgggcagtggcgccgggccagggtcacggcctgcagtccgttcgccgcctccgccacgacggtcagaccggcggcggcgtcgacgatcccgcgcagtcccgcccgcatcagatgctggtcgtcggcgacgaggacccggatcgtcacgcgccgcccccggcggacagcggcagccgggccacgactcggaagccccggccgggcagcggctgagcgctgcactcgccgccgtacaccgccgcccgttcccgcatgccggccagccccaacccgccggccgggttgcccgccgcggccgcgccgacgccctcgtcgatcacctcgacggccacgtcgtcccggccgtaccggacgacgacccgcgccacgtcggtgccggcgtgccggaccacgttcgtcagcgcctcctgaatgatccggtacgccgagaggtccacgccgggcgccagcgtccgtatcgggccctcgacgcgcacctcgacccggacacctgcctgcgcggtccgggccacgagcccgtccagatccgcgagccccggcatcggcgacacagccaccgcgccgtcgtccgtctcgtcgctgcgcagcaccttgagcagccggcgcagatcggcgagcgcctcacgtccggtgcgctggatgacgccgagcgcggcgccggcctcggcgggccgctcggcgatgacgagctcgccgagagccgcctgcaccgtgatcacgctcatgctgtgggccaccacgtcgtgcagctcccgcgcgatccgcatccgctcccgggcggccgcacgccgggcccggtccgcctcgacctcaccgagcagggcgtggtagcgcaccagttccctgtcgtagcgccgctgccggcccaccgcgagcccgacggcccacgccgtgcagaagagcagcgcgtacaccagaaccccgccgcgcaggcccggccgcggctgcgcggtgcccgcggcgccggccagcgccagcagcagactcccggcgacgaccacgcgcccgccccggagcgcggagctgaagagcaggaacagcatcggaacggcggcgagcatggccagggtgccggcggccggccggaaggccgagctgagccagcacccggttgccagaagccccagcgccaccaagggaagacgccggccgaggacgatcgccaccacgccgagcgagccggcgccgagcgacgcgacgccggaacgggccgggtgagtcgccacggccccgatgatcaggccgtagcaggcggcgaggccgcagtcgatcaccacgcggtgtcccgggcgcagggcccggggcgcgggtggacgcgttggtgcggtcaccggcccaggctacgacgacagaacacggccgtcgccggtcgccttcacgagttttccgccgccgaccaccccgatggtgaccggcgaatcgcggcagaggtcttcgcgcacggggccgtcgtcccggccggtcgtcaggatcccggggtcacctcaggtcgctgccctggtccgcgaaggccgtcaggttcggctcggggtccgggacgtgcagggaccaggcgttcgccggcttctgcagtttcgcggcgtacatcgcgaggtccgcgtcgtacagcagcttccggatcgcttcggcgttgctgtccggcagcgccgtcgcttccatgacggcgaccccgatgctggcccccggccggcgcggctggccggcgatcatgaccggctcggccatcgcatcgatgatccgctgggccaccgtgaccgcgccggcactgccgccacagttgttcatcaccaccgcgaactcgtcgccgccgagccgggccacggtgtccgacccgagaacgctgtccttcaagaccttggcgaacgcgaccagcatggcgtcgccggcctcgtggccgagcgtgtcattgatctgcttgaagccgttcatgtcgatttgcagcacaccgatcggggtgtccaggcggcggctgcgctccagagcgcgcgccaggctggcatgcagctgtctgcggttcgccaggccggtgagattgtccgtcacgaccagctggtggttctcccggagcgccaccagctgccgggcggcgaccgccccggtgaccagggcggctccggccaccagaccggcccacgggtagagaccggccagccaggccgcccagaacagcaccaggtacgccaccccggtcgcgaggtacggcagggagctcacccgccgcagcggctcctcctggcgctcggcgagatgctgccggctcgcctggtggcactgcagggcggcggcgaaggccatcaggtaccaggcggtcagccagcagcccagctgccacgtcggggtgccgccggcgtgcgggtggctcttgatgtaaccgagataggcgtcgccgacgatcaggaaggacagcgcggtgatcaggaacaacaccggcttgcggtcggctgtggtgccccgcaccagcacgatgacggcacccagcagcaacgccagatcgccgagcgggtagcccatcgcggtggccaactgcagggcggacaggccaccggcggcgaccgtgggcccgatgaccaggaaccagaggatcatgaacccgcagcccaccacggtcagcacgtccagcaggttcttcgtcgcctcccggcggctgcggccggtggtggggaaggtgagcagaccggccagcatcgccggggggaagagcgcgtgcgccagatcaccgagcgacggcacgacggccgtgttcccggcctggcccgtcgcggcgtagccgacgatcgacaggatgagggcggccgagctcaccgcgatcagcgcccatgcccgtcgcgaccggcccggcaacccccggtgacgggcggcgcggacaccgaaacccagagcgatgatgttgccggacaggaagcccaccggaatcacggtcgcgaagaaggcggcgctgccccgggtcgccaggaatgcgccggcgagcaccaggtagcagccggctatcacgatcaggccccacggcggacgcggtctctgccggccgagtgtcgtgcttcgctgcatcaccgctccgctctcaccgatcgtcgtcgggcacatcggccggattccggtgcagttgagcgccgccgcaccgtgacctcaccatccccggaaccggacacttcccggcggaggcgatgatcagtgaggaatcggcgcaggggctggttcgcagtggcaggtgtgacggtcagcgttccgctcacggtgatgtcgatcgggtcgtcgccgtgcgggtgtcggtgcagctgccatcgggcctgctggaccgccgcggcatcggtcaccacctcgaccgggtcagccgcgccggacgtcgccttgaacccgttcatcatccgggttcacgacgcacacgacgcggctcgccgtaaggggacctgatcggccttccggaaatatgctcgccggcgagcgcccaggcgggcggtcttactcctgtgccggcttcgctgtcttggccgcggccagatcagcgcgcagcttggccaggtcctccttcaccgcctggtgagcggggttggcggcgatgacgccggccttcgtggtcgccgagtcgacctgcttacgccaggccgcggtgtcggacaccgtcttggtgatgtcagccagcaggatcgtcttcgaagccgcaaagtgcggcttgctcgcgacttttgcctgcaccgtctgcatcttggcggcgatgtgctgggccttggtgtccaccgccgcctgcatgctggacagggtacgggcgggcttcgacgacggcgtcgccgcgaacaccggaccagcggcagcaacagctgcagcggcggtggctccgatgagagccaatccccaggcaatcctcataaaaacctcaaatcggtcgtagtgtgcttttccggcgacaataatctgtcagccgtaggtgtcccaacacgaagcggccgattcaccggatcgcggtcgtccacccggcggccagaccggtgcaccgctcgatcaacgagcgcgaccgacaccgacgaggcggtccgcggtgttgccgggtcaggcagccgcgtcctgccgctgcagaaccagcaggcccgtgatctgtgcggcctccatcggccggcccaggtggtatccctgcccggcggtgtagccgagcctctgcaaccgcaccgcctgcgcttcgttctcgatgccctcggcgaccgcctccagccccagggcatccgccagctgcatgaccgcgcgggccaccgcctgccgggcgtcggcccgcgcggtacccggctcgtccagttcgatgccgtcgacgaacgacttgtcgagcttgaccatcgcgacgggaaaggaccgcagcagactcagcgacgactcacccgtgccgaagtcgtccagcgccaaccgcaccccgagctcgttgacctcgtggagcacccgcgacacccgaggcccgcgcaggaccgacgattcggtcagttccaggaccagcttctcggcgggcagtccgctgtcggccagcgcggcccggacgtcatcgacgaaatcggggtcgtgcagttgacgtaccgagacattgggttcgaccttctgcagggcatcgggcccgaactcggccagccaggcggcggcctgccggcaggtctcccgcaggacccagcggcccagcggcacgatcaacccggtgcgttcggcggtcgtgatgaagtccagtggcggcaccaggccacgctgcgggtgatgccagcgtacgagcgcttcgaccccgatcatccggcggtcggcaagatcgacgacgggttggtagagcagccggaattcgtcggcgtccagggcccggcgcaggtcggctcccagctgcgcgtcggcgaacaccggctgctgcaggtcggcggtgtagcggatccagttgcccttgccgcgttgtttggcggtgtgcagcgcgatgtcggcgtcacgcagcagaccgctcgccgtcgtcccgggcttcgccccggcgatgccgatgctggcgtgaaccaacagccggtgcgcgctgatcggcgcgtcgaacgcggtcatgagccgccgggccaccgagtcgccgaccgcagcgggcccattgatcaaaaccgcgaattcatcaccgccgagacgcactgcccgcccgtcgtcacccaccgtggtctgcaaggtcagggcgaacgccgccagcaactcgtcaccgacatcgtggccgagggagtcgttgacggtcttgaagtcgtcgagatcggccagcagcacggtggtgtcaccggatggcagagccgtgtccagccacgagcggaacagcgcccggttcgccagcccggtcagcgggtcgtgggtcgcctcgtagagcagccgccgctcggactccttccgttcacccagcaatcggacgttttctcgcatgaccaggtactgccgggccatgaccagcccgatgacgagggtcgccatgacggccaccacctggccccggtcgccggtccggcgcagcagcacatcggtcatcgtcacctgaaccgcggcgaccgccaggtacggcagccaggtattcgaccgccgtggcggcgccgccgtggagacctgctgccggtgggccgccagcgtgatcagcaccggcacgaacggcaggaccagcgcctgagccagcagcggccagtccgtgccgcggtcgaccacgaggatggccaccacggcggcgaccaggcccgtcccggcgagcagccggatggcgacccggtcgacagggccgccgttgatgtgggagaccttggtgatgctggccgccgccagcaggaacgccagcatcatcatcgcggtcaggggcagatccctggggcgcggggagtagaccagcggcacgaggccgaagtgaaacagcaccgccgtgcacccgagaaacgcaatggtccggtccagccactgccgtccccgttcgtacccgctggtgacacccagcgggacccgggcaacggcgtagatcgcgacgagcacgccaccgcagaccccgacggtcgcaacggccggcatcggcggaaaggccgggcggctgcggaacgccgcgaccgccaacaccccgtacccgactgccagcagcaggcagcctgcggacaactgaagccagaaccgtcgaccggccggcgccggcgcgacggcgcgcaccatcgcccggatggccagcaccgccgagagcaggccggccggcatgaacagatacgccaccgccatcgagccgatcccggtcgacgaccaccagaggaaccacagcacaccggctgccgcgattccggacgtgacggccgaatgccaccacggtcgtcgacgcagactccccataccggcacggtcggcagcttcaggcaaatctgtagaattgtcccgagagtagttgtaaccggccgagccgtcggcgcggtgaagcctgacttttcagctgtcccatgatcgctgcctccccaccgaaaaagccgaaagaggccccgagccgatccgggttacgggcccgtcagcgcagtcgcgccgagggcttctaccagtggatatacggtccacttcgcggagggaccgagcacccgtgcgactgcctgagttctgcgggcgtgggagcagcatgccgcccagtgctgaaagttgtcgcaaagttacgtagggtgtctcctcgtgtagtgaaagtggaggatccatccgggttcgatccgttccaacggatcgcacgggggaacggcatggactaaaccagggagacctgatgcggacactggccgaccaccccttgactgctggcccggagctgacgccaccggcggagccggcacaggtcaccgtgacggtgatgctgccggatctcgatcacctccccgcctgggcgaccgtcttgcaggactggctgcgacagagctccggcgaccaggccgatgaaccacgtgacgccgccggcaccgaccagccgcagaccgcatcggcaccggcttcggtacccgaactggtggtgaacccgaccgctcgcaccgcccatgtggtcggccgcgcgctgcggctgacccggcaggagttcgacctgctgctgtttctcaccacccacagcggacgggtgttcacccgcctgcagctgatgcaacaagcgtggaaaggacccgctgaccgcaacgaacgctgtgtcgacgtctacgttcggcggctgcgggtccaccttgccggccggggcccgaagatcaccaccgtgtacggcgtcggctaccgcctcgacgacagccaccacgccaccgttaccacgtaacgcgcatcggcgtgtgatcagggagcgggtgcgtaccaggatcggtggtttccggctctcggttggtaggtctcggccgccggtaggcagcatgggccagaacaacgccgtacgcccgccgcggcgcggcgacgggagcatggcgcgccgcgggaggccacggatctgccgggcggcgtcgccccggccggcttgcggccggggcgatcgggtgtcgccgggtcagcggcgcttggcctccttgcacatctgcttccagaccttgcgctgctcggccatcgcggccgggtcgttgcgtcggtcctggtacgcctgctcccgctggatcctgcgccagctctccagccgtcgctccggcagcgagccgtcccggaccgcctcctcgacggcgcagccgcggtcaccggcgtgcccgcagtcgcggaaccggcagtgccgggccgcctcggtgatgtcggcgaacgtctcgccgacgccctcgtcggtggtgagcaggtccagcgagcggatcccgggcacgtcgagcagcactccgccggcggaggtacggaacagccggcgcgtggtggtggtgtgccggccggccccaccggcccccacctgctggacctgctcgttgcggccctccaacgcgttgagcagcgacgtcttgccgactccggaggcgccgagcatggtggtggtggtaccggggcccagatggctgcgcagctcctccaggccctgccgatcgagggcgctggtcaccagcaccgggacgccgggcgcggcctggccggcctggtccagcgccgcgccgatgtcggggcagccgtcggacttcgtcaggaccagcaccggtgcggcgccgctgtcccaggccatcacctgcagccgctcgatcgcctccaggttcagcggccggtcgatcggctgcacgatcatgatggtgtcgatgttggccgcgaggacctgggtgtccttgccgttcgggtccggccgttgcagcgcggtgcgccgcgggccgacctcgaccacccgcccgtcctggacggccacccagtcgccggcgaccggccgcaggttcaggtcccggccgagctcgaacgtgtcgtgcacggccgggccgtcgccggggaaccaggccagttccagcgcccggccgtgcatgatcaccacccggcccgggcgccggccatccggagtgtcggcgaaccgcaggtcgtcggccggtgaccagccgagctcacgcaggtcgtccgggtggaccgaacggggcgagtccatacgtgcgtaccttccgctgtgcgacgtcgtctcagtgatcgtaggtgtcggcttcgtcgatgtatcggatgccggagagcaccgaagcccgcggcgtcacggtcagcaccccggcggccgccggctcgtcgtcggccagcccgaacatcggcagcgcgggagccaggccctcgatcgtcaccggcaagcggtggttgctgcgccacgagtcccggtccagccgcagccggttgctgtgcacctgctcgccgcggaccacgttggtctggacgccgtcggcggcgaaaccgagcttcttgctgaccgccagcgacggcaggttgttctgccggaccacggacagcacgtagtcggcgccgagaccctcgaacgcgagcgccagcatggcggcgcgcgcctcggtgccgaagccctgaccctgatagcggcggcccagccacgcggtgaccagggcctcgcggccgtgagcgaagtcgcgggcaccgaggctctgggtgccgaccaccgtgccgtcgtgcacgaccaccaggtacagcgtccagtcgtcggctgtccagctggcgttggcgtgccactgccgctgcagcagccgccgggcgaccaccgtcggttcgccgtcggtccactgcgagaagaacggcatgaacccgggctcgtggacgccctcggtggcgcggtcggccagcgcgttcagatcgtcgttgtcgggccaacgcagctccagccggggcgtacgcaggcgcaggtcggaaagcggccagtggttgatcatgcgagttccatttcttcggtcggggtggagggggagcgttcgaagtcgacgtcgtcggagatccggccgcgcagcacccagaccagggcgctggtgagcaggctgacggcgatgagcaggcccatcaggggcaggccgcggtgcggtggcagcagcagggcggccagggccgggccgagcacgctgccggtcgacagcatcgtggagaacagggcgttcgcccggccgcggacgtggtcgccgaccacgtcgttgagcagcgcgccgagcaccgggacgacgagcacctcgccgatcgacaggcacgtcaccccggccgcggcgaaggcgatcgccgtggtgccggtgtgggtgccggcggccagcaccagcacccagcaggcggcgaagagcaggccgctgagcccgaccagggtggtgcgccgcacccggtgcagcgccggcatgaccacgaactgggtcaccaccgccaccacgatgttgagggtgaaggcgaacgacagcccaccggcgcccaccgcgccggtgccggtcaggtagccgggcaggccggagcggaactggccgtagcagaccaccgaggtcagcagcatcacggcgagcagggccagcagccgcgggtcgcgcagcacgctcaggtagccgccggccggtttcccggcggcctttcccggctcgttcctgccgccgggcagcagggcggcggtgacggcggcggcgagaaggaaggtgaggccgtcgatgaggtacagggcgccgaagcggtcgaccgcggtgccgaagtgggcgaccgtgaccaggccgccgaccgcgacgccgaccccggtcatcgcgttgaacacggcgaagtcgacggagaaggccagggtgcgctgggtgccctcggtgaccgcggcgtacatcgagcgcagcaccgtgccgacgccgctgatcccgatgccgtagccgaccgcggtggccagggcggcggccggggtgccggccacggcgtacgcggcggtacccaggccggcgatgaccaggaccgtcggcaccacgatccggtacggcagccggtccagcagcgcgccccagatcaggccgccgaccaccgcggtgccggcctgcacggccagcgtcgcggcgggcacccagaccggcaggccgcgcacctcactgaggtagatccagaggaacggcagcaccagaccgccgccgaacgagctgaccgcgttggtccacagcaggatcttggcccggccgggcagtgcccgcagccgggtccaggtggcgctcagcatgccggatccagggtgtccagcgcggtcagcagcgcgacgagctcggtctcggcgccgagcgacacccgtaggtatccggtgagaccgaaccggccggcgtcgcggaccaggatcccgtaccgctgctcgagctcgcgttccagctcggcactgtcgcggcggactgccacggcgacgaagttggtcaccgagggcagcgcggtgcgcccggtgtcacgcagccgttcgacgaaccactcgcggcggtcggcgatcgtttcccgtacgtcgtgaagatgcttctgatcggtcagcgccgcgatggcggcggcctggcccacccggttcaccgagaacggcatcgtgccctgcgccgagcgcaaccggccgatcagctcggcggtgccgacggcgtacccgatccgcaccccggccagcgcgtacgccttggagaacgtccgcagcgacagcagcggcgccccacggtcgagatagtcccgcacacacggcgttccggccggggcgaactcctggtacgcctcgtccacgatcagcggcgttccggtccgtgccgccgcctcgaccagcacctcccactcggcgccggtcagcgcggtgccgctcggattgtgcgggttgcacacgtagccgaccccggcgccggcgagcccggccgcgaacgccgccacgtcgagccgcccgtcgcgcagggcgagctcccggtgcccgcgcccgaccgtgtccaggcagatccggtagccggggaacgtcgccgcggtcaccaggccgggccggtcgcggtcaccgatggtgagcgtggacagcagcaccagctcgtcgctgccgttggcgaccgcgacctgcgcggggtcgaccttcgcgtgctcggcgagcgcgctggtgagctcgacgcgggccgggtcggggtagatgtgcaggtcgtccagggcggcatgggccgccgaccgggccagcgggctgggcccgatcgggttctcgctcaggtgcaaccggatcggcgcggcggccgaccggaccggggcgctcacgcgtcctcacccagcaggacgccgaagcagtagctgcccggttcggccgccagggtcacgaaccggtgctcggcgccggccgggatgtacagcgtcgccggcgagctcagctcatgctcgtcgccgtcgagcagcacggagatccgcgccccgcccgggttcggcgacaccagcaggtagatctccggcaccgggtgggtgtgcgggtcggcgaccggcttgccgaccttgtcgctgagctccccaccggccagctgcaccggcaggccgccgaacatgtcggaggtgaggtagaacggcgcgggctggtggtggccggcgacggctttgaacagcgggaggtccgtacggatctgggcggttgtcatcgcggttgcggtccgttcctgaagaagaggcgaggggggcgggtcactcggcgtccagcacgtagagccacgagtgcggggtgccgaacgcctcgacccggcgcggccgcagcccggcggcggcgaacaacgtctcgtactcgtcgcgggtgtgcagcgggacacccatcagcgcgtgcgccagttcgtacccggtcgagaagatcggcagcgacgactcgtcctgggcgggccgcagcatcgtgtcggccagcacgaacgtcgtcgccgcggggaacgcctcgcgcatccgcggcagcacctgggaccggctggccgggtcggcgagcaggtcgtgcatcaggaagaagctcatcacggtgtccacctcggccagggcggcccggtgttcctggcgcagcacgacgtcgagcacgttgcactggatcgcctcgacccggccggtcagcccggcctgcccgatggtctgctgggccagctgggtggcggggccgctgatgtccaggcccagcccccgggcgccggcccggtcgccgagcacccggcagacccgggccgagactccgctgcccaggtcggcgaggacgtcgaagttcagctcgccgagcacgtcgtcgaggatccgggccatgaacgagccgtcgttctgcgccgacccggtggccaccatcgcctcgtcacggtggatgtccacgccgaaccggcggtcaccggcggtgatcccggcggcgccggcgaacacctcgttgtagccgccgaccgcccaggtgaagtagccacgcatcgcggccatctcgacaccggccggggtgaggcgcacggtatcggcgtcaccggtcaggtagccgaacgtggcggcggcgcgcagcagctcccggaacatccgctcgtccacgtgcaggtcgccggcgaacgcggtcacccgcagcggaccctcgacgagccgcgcccacacgccgagccggtccagggcgaagaccacgttcgcggccacgtacccgttgaagacctggtcggcgtcgatcgggacggtggcggtgccgtgccagtcggtgggcagggagcgggcgggggacagggtcatgacgggctccttgtggttgcggtgtcgagcagttcggcggccagctggtggatgtccaggtggtcggcgagtgcctggtgcagcgccacgacgagatcggtgcgatcgtcgtacgggcgcagggctacgtgcagcaggggcgcgtcgaccggctggaaggcgtggtcggcggcctcggccccgggtgcggatcgggtcaacgtgaccagcgggtggggcatctccgcggcgacccagcggtcgtcacggcggcggaagacggtgcgtagcagcgggcgggccaactgggcgtcgcgcagcgcggcgtccagggcgtccgggtcgggttcccgctccagcgggatgctgagctgcacggtgtgttcggcgctgctgctgccggcgcgtaccgcgtcgtggaagacgaggcgctgctcgcgggcggtcagcggtcgttcccgccgggtggacccggactcggcggtcgcgatctcggtcaggtcggccagcacctgccggtcatccggtgccgccgcgagctggggcagcgtcggcgcgtagccccatcgtgccgcgatggcccggcgcagggtgaccagggggccgagctcggtcccgggcgtcgacgtgccgaacacctcgcgccaggcgttggtgacggcctgtgcggccgccggccgcgggtcggcgtcggcggcccgctcgaacgggtagccgggcaggtgcacccggtcgccgggagcggacagcaccacgtcggcgcccaggcaccacacttcggccgccgcggcggcgagcgcggccacctcgtcctcgccgggcaggacggcgacgacgatgtccccggccggtgacaagccgggccgcgggccgatctccaccgacagcacgtcgggggcggccggctgagtgtccgggcccgacggggagggctcggccgtcccgggagccggcgagtgcggctcgccggcccaggcctgggccaccgcggtggtgatgtcgagctcaccggccagcaccgcggcggtgcgggcgccgaccccggcgccggtgcaggtgtcggcggtgacgccccactcccgcagctgctcggcgatggcgtaccccacggcgaccgtcacggcggcggcccgatcgccgggggcggccggggtgccgccggccgccgcgtcgagcagccggaccggggcgccgaaccgttcggtcagggcggcatccaggtcgtcgatgacccgccgcaccgtggcgagccggtcgtaggcgtcccgcccgaacccgtcccgcgcaccgtcgccgaagcggaacaccaaccggggtgcccggccggccggtgcggcgccgcggatcgtcgggcgctcgccgcgcagggccgcgaccgtgccgtcccggtcgccggcgaccaccacgcaccggtaccggaacggttcgcgtccacgggacagggtggcggccacgtcgtcgagtgccacccgtgggtgcgcgaccaggtggtccgcgatccgttcccgcagccgggtcagggtggccgcgctgcgcgcggagagcggcaggaacctgatgctcatgctgtcacctgcgccgcgtcgtggtgaggccgtgcgtgggtgacggagctgaccgtctcgctcatgcggtttctcccgccggtacgaactgctggacgatgacgtgtgcgttggtgccaccgacaccgaacgagctgaccccggcggtccgcggccggtcgtgccggggccagtcccgcccggtgggcagcacggtgaaccggtcgccgtgccggcgcagctcgtcgatcggttcgctgacgtgcggggtggccggcaggaaaccctcccggaccgcgagcaccgtcttgatcaggccggccactccggcagcggtgttggtgtgcccgatcgacgccttggccgagccgaccgccaccggtggcccgtccgcgccgagcgcctcggtcagcgcggccacctcgatggtgtcgccgagccgcgtgccggtcccgtgaccctccacgtagtcgatgtcggcgccgctcaggcccgcggacgtcagggcctgccggatcacccgggcctgcccgtcgaccccgggcgcggtgtaaccgaccttggcccggccgtcgttgttcaccgcactgccgcggatgaccgcgtggatcgggtcgccgtcgcggatcgcgtcgccgagccggcgcagcagcaccgctccggccccgtccgcgccgaccgtgccgctggccagctggtcgaacgggcggcagaagccgtcccgggcgtacaggtggccgggcacgtaggtgtagctgccgtccgccgggtgactgaccgagacgccgccggcgagggcgtagtcgctggcgccgcggcgcaggctctcgcaggccaggtgcacggccaccaacgaggtggagcacgcggtgtccagcagcaggctctcgccgaacagatcgaaccagtaggagaaccggctcggcatgaacgtggcgtcgctgccgaccacctcgtcggcccgggtcgactcgtcgcggtccggcagggcgcgggggccggggccggtcgcacgtccggcgtacaggctggtgcgctggtggatgtcggccatgcgcagcgcggcgttctcgaccgcgccccacaggcactcgtagaggatgccgtgctgcgggtccatcgtggcggcctgctcggggtcgaagccgaacagcccggcgtcgaagcccagaccgtcggcgagcatgccccagcgggctacccggcggcggccgtcggcgtactcgtgggcgaccgggtcggcggcgttgggcaggcagtcgcggccggccaccaggttccgccagaacgcgtcgaggtcgggggtgccggcgaaccggcaggccatgccgaccacggcgatgtcgtcaccggggtcggtcacggcgaccgcggcggccgtcgtggccggggcgtcgccgatcagcagccgggtctgcgcggtcaccgtggtggcccggaacaggtcggcgatggtcggcctggccgcggtgtgccggtgcagcgcggcggcgagctgtacgacaagcagcgagtgaccgccgacgtcgaagaagttgtcgtcgtcgcggaacccgtcggtgccgagcacctcggcccacgccgcccggaccggagccgtcacaccaccggtgagccggcgtccggtgcgcgcgggcgcgggcgccggcgcgggtccgtcggacggcgccgggagccgggcccgatcgatcttgccgttcggtttcagcggcagccgctcgatcggcaccagatgccgtggtacggcgaacccgggcagccgcgcccgcaggtgctggcgcagccccgccagctcgtccgggtcggtcagcaccgcgtacccgacgatctccttgtcgccgcgggggccgacccggcaggtcacgaacgccgactcgaccgcgtcgtgggcgagcagcgcggcctccacctcgccgagctcgatccgctggctgcggatcttgacctggttgtcggtgcgcccgatgaactccagctcaccggtggcgtcccagcggacccggtcgccggtgcggtacagcctggcgtccggccgcgggtcgaacgggtcggcgacgaacttctccgcggagcgtgccgggtcgccgaggtagccgtccgccacaccggtcccgccgagcaccaactcgccgggaaccccgggcggggtcggccgcagagtgccctcgaacaccacgtacgcgctggtgcccggcaccggccggccgatcgggacgctgcgggcgccctcggccaccgcggcgatcgggtgccaggtcgaggtgaacgagttctcggtcggcccgtagctgtgcagcagtgtgcccggcccgcaccagcgcagcgcccgccggatgtgcggcacggagatcagctctccgccgaagtagacccggcgcagcgactgcagcaggtccggtgcgtcctcgatgatccggttgagcaggggagtggtgaccagcagggtggtgacaccgtgctcgcgcagcgcggtgcgcaacgcacgcgggtcgaggaccagctccttgtccagcacgaccaggcgggcgccgtgcgccagggcaccccagatctcgtacgtggcgccgtcgaagttcagcggcgacaggtgactgaggacgtcgtcggcgccgagcggcaggaactcgggccggccgaccagccgcgcgacacccgcgtgcggcagcaccacgcccttggggcggccggtggagccggaggtgtagagcacattgagcgtggtggcgccgtcgatcggcacctgcggcgggtgtgccggcaggccggcggcggcggccaggacgtcgctcaggtcgtacaccgtggtggggagaccgtggcagcggtctcgctgcgcggggtcggccagcagcagcaccggcgccgcgtcggcgaccaccagctccagctgggcgtccgggtaggccgggtcgagcggcaggtacgcggcaccggccagcgagcaggccagcatggccacgaccgtgtcgacgccggccggcagcagcagcgcgacgatgtcgccgggccggaccgcctgcccggtcagccagtgcgcgagagcgccggctcgggccaccaggtcgccgtagctcagcgacgtggcgccgtgctggacggcgatcgcaccggggcggcgtgccgcgtgctccagcacccggtgcggcaccagcaccgacgcgtccgcatcggacagttcggcgccgtgctgatgctcgtgcgggcgccgttcggccagcaccgtgagcaggtccaggcagcttcggtcggggtcggcggcggccgcgccgagcagcgcgcacagctggtcgccgagttcaccgatgctggcggcggtgtagacggccgcgtcgtagtcgaggcgcagcacggtctcgtcggacccctccgcgacggccagggccaggtcgtacttggcggattccagctcgtgctcgacgatgcgcagctcagttccgccgaccgtccagtgccgctggccacggccctgataagcgaaaacggtccgcagctccggggcgccgacggccgcgcgcagcgcctcggtgtccacctcggaggcgaacagcgagtcgagcacctgcccgctcaggtcggtcagcaccgcgcggaacgggcgctgcgcttcgaaccggctgcgcaccggcaggacccgggtgaacaggccgatctcggcgtgtgtcgccgggtccagccggccggcgaacggcatgcccagcacgccgtcgggttcaccgctccaggcgtgcagcagcagcgtccacacgccgagcgccgcgaccgcggccgagacctgcccgcgctcggcgagcccggccaggccggcgcggccgctcgcgtcgagggtccaggtgcggtgggcggccgggccgggcccgtcgccggtgcggaccaggtcggggatcggggcgagcggcccgcactcgtcgtcgagcagctgctgccagtagcgggcgtcggcctccgaggcggccgggaccgtgggttccggcatcggggacacggcaccggcgccgccggtacgggcctggtagaaccgtacgaaatcctcggccagcaccccgcacgaccagccgtcggtcaccaggtggtgtgcggtcagcaccagtaacgcggcgtcgtcggcccgcagcaggtcggcccgcagcagcggcgcctcggtgaggtcgaacggccgcgcaccggcctcggctgcccaggccagggccggttccggccggtacgggccggggcggtgctcctcgcgcagcgccaccgtgaccgcgtcggggaagtactggcgcagctcgccgtcgtcggcgcggaacgcgctgcgcagctgcgggtggcgggcgagcaggtcggccagcgcgccgtgcagcgcgtcggcgtcgagcggcccgttgatcagcaggtcgatcgggacgttgaaccggccggactcgggttcacgctgcaccgccagccacaggtgggactgctcggcggtggccgggcgcccggtcagcacggtgtcccgctgccgctgggcacgagggcgcgcaccgcgctggtcagctccgtgacgctctggttgtcgaagagcagccgcagcgggagcggggcgccgagggtggtccgcagccggcccatcatcgcgatggcgagcagggagtgccctccggcggcgaagaagttcgggtcaccggtgacgtcgtcgtgcccgagggtggtggcccactcccggcggatcgtggcggccaggtccgtgtcggagatggcaggtgtggtcatgacgcgatttccctcggagctggggccgtggcggccaggtggccggcgagacggcgtacggtcgggttctcgtacagggcccggacggtgacgcccgggaagtcgccggcgcgcagcgcgccggccagccgggcgagcagcagcgagttgccgccggcgtcgaagaagttgtcgtccgggcgcagggcgggggtgagcaccgaccggcaggccgacagcaggccgtcggcgggaccgtcgtcggcgccggtggccccggtgcggtgcggttccggcagcgcgcccgggtcgagcttgccgttggctgtcagcggcagcgccggcacggcggtgaccgtggccggcaccatgtagtcgggcagcatccgggccgcccgccgccggatcgcggcgagctgctccgggccggtgccggcggtcagcaccaggtacgcgtcgagacgggcgtccccgcccggcccggtccgcggcaccacggcggcggcgaccacgaccgggtcctccagcagcacagcccggatctcgtccggttcgatccggtgcccgcgcagctgcacctgagcgtcggtgcggccgaggtgttcgagccgcccgtcggacagcagccggccccggtccccgctgaggtaccagcgtcggcccgtgtccggatcggtcacgaaacgctgtgcggtcagctccggccggcccaggtatccggtggcgaggcccgcgccggccaccgcgatctcaccgatctcaccgcgcggcagcggctgaccggccgggccgacgatccggaccgcccagccggcgatcggcctgccgacactgcgcgagccggtccgtacctgctcgtggccgatggtctccgcggtcacgtgcacggtggtctcggtgatgccgaacatgttgaccagccggcaccgctgcggtgggtaccggtccagccacgggcgcagcgcgcgggtgtccagcggttccccgccgaagatcaccagacgcagcggcagcggtgcggcgtcgtggcgctccagctccagcagcccggcgaacgcggacggcgtctggctgagcacggtcaccgcctgctcggcgagcagccgccggaagtcctcgggcgtgcggcgggtccagcggggcacgaccacgaggcggccgccggtcagcaggcacccgaagatctcccagaccgagaagtcgaacgcggcggagtggaaccaggtccaggtgtcgccggcgtgcagggcgaagtcctcgcggaccgcgtcgatcagcgcgacgacgttgtggtgcggcaccacgacgcccttgggacgcccggtggagccggaggtgtagatgacgtacgcggtgccggccggtccggtgccgacggtaccgtccaccgccgtcagagcggaccaggcgagcaccgtgccgacggcgggcagccgggcggcgccgtactcgtccgcgatcacgtgggtcagcccggcgtcctcgatcacgtaggcgagccggccggccggatggtcggggtcgagcggcacgtaggcggcgccggccttgagtaccgcgagcagcgccaccggtaggtcgacgccgcggtccaggcagacaccgacccggtcaccggcccggaccccggccgcgagcagggccgccgccgcccggtcactgtgcgcgtcgacctgggcgtacgtcagcgcggtgccgccgtcgtggagggcgatcgcggccgggtcgccggcgaccacccgccggaaccgttcgtggatcagatccggttcacccacgggaccgctccaccagggcgagcaccacgggggcggcgtcgaccaggtacatgtggccgccgggcagctccgcgccgatgaaccggccgtcggtcacctcggaccagcgggccgcgtcggtcgccgtgaccaggtcgtcggcggcgccgcggagtgccacgaccggcacggcgagccggggcagcggggcgggtcggtactgctcctgacaggtgacgtcggcgcgcagcgcgggcagcagcaactcgcgcagttccgggtcgtccagggccgggtgccggtagccggcgatccggcgtaccccggccacgaactcgtcgtcgggcaggccggtgatcgcgggccgggtgccggtgcccggtgcggcggcgccgctgacgatcagggtcagcccggtgcggccggccgcggtgagggcgcgtaccacctcgtaggccaccgacgcgccgaagctgtgcccgaagaagaccacctcggggcggtccgcggtctggtcgaggatgcccggtacgaggtcgtcgaccagcgcggtcatcgcggtgagcggcggctcggcgaaccgcttctcccggccgggcagctcgacgccgtgcacgtcgaggccgggccgtacgccgcgccagtcgtggtagaagccggcgccggcgcccgcgggcgggaaacagagcaggggtacgggagtcatgaggccatttccaggtcggtcgccggacggcggtagcggtagcggttgccggccgccagcacctcgcacacccgcaggtacgacgtgtgcaggtcggtcacggtcgcggcggcgagccacacggtctgcacccggccgagcgtgccggtgcggtagtcgaccgcctcgccgggcatgaccccggtgtcgacgcgggagacgccgggcaccgcgcgcagctcggccaggtcggcggcctgttccagacgcaccgcgtccggtggcggctggacgaccaggaccagggcgtaccccgtgggatcgcggtggtccccggcggtggtgtcgccgacagcggcgcgcagggccagacgaaccgggtcctcgccgttgacccggccgagcaggccggcgacgaagccgccgagccggccgttgacctcgatcacccgcggcccgtccggagtcagcttgatctcggtgtgtgtcacgccgtgctcgacgccgagcgcggccagcgccgccccggccagcgccaggacgcggtccagcaggtcggccggcagctgtgtcggggagaccatgccggtctcgcgcagcggccaggtcagcggcagccggtcggtgaccgcgaagtgccggtaccggcctgcgccgagcgccacgctctcgaccgacacgtagtcgccgagccagccgccgcccgggtgggcgccgtcgcgcagccgttcctcgagctgccacgtgccggcggcgccgaagccgaacgcgtcaccggcgatggccggcaggttgaggtcctccccggcgcgccggcatgccaggtgcagcgacgccaggtcgtcgaccggcgtgacgtgcgcgctggcgttgccgaccaccggcttgagcactgccgggaaaccgacgtgggcgacggcggcggtcagcgacgccgggtcgtcgaacgtggcgcagcgcatcgtctcgaccccggcggcgcggagccggtggcgttgtacgtccttgcgcagcagtgcctcagcggtgaccgggtcgtggtacggcagatcgagcgcctgcgccaccgccgcgacccggggcagcaggtcgtcgctgaacgcgaccaggccggtgacgccgtaccggcgcagggccgtggccagggcgtcggggtcgaggtcgcggacgtcgacgtagtgggccaggctggtcagggcggccacctcggccggtccccacggccggttaccggtgttgacgacgaccagctcgcaccagccctcggcgacgtcgagcaggtcggcgagcccggccgacccggccgccgcgaagtaggcgacggtggtcacgccgacgtcgccggtcgcgtccgcaggtagcggtgctcgccgtcctgcacgccggtgtaggtgaagccggcccgggtcagcacccgctgcgacggggtgtggtccggctcggtgccggcctgcaactcccggacgtccggctgggtgaacgcccactgtgccagcgaccgcagcgactcggacaccaggccccggccgcggaaggccggcacgatgccgtagccgatctccgcggcgccgtcggtgtccggggcgccgtggaagccgatgtcgccgaccacctggccggactcgcgctcgatgatctggtacatgccgaagccgggccggtgcaggccggccgcggctgcccgcaggaacgcgccaccggcggccagggtgccgtcgaggggatagcccggcgcccacgactgcccggcgggcgcccgcccgccgacgacctccgcggcctcggcggcggacagttcgcgaagccgcaggcgggcagactcgatggtgttcgcgggggtcgggtcggtcatggggtgtcctctcgggtcatccggtggaaaacggtggtgctgtgctgccagaggagcgggaacatggggctggctgccatccgctcgaggtcgctgatggacctgccgcgcaggctgctgggtttgtccgcgtcgccggggtcggtctcggcctgcggctggccgccgagcagcagccagaccatgttcaggtggacctgcttccactccaggatccgggcgtcgaagcggtgcagcccgatcatcacgtcggccagcagcaacggcccggtgtcgccggtgtaccggggttcggcggccgcggacagcgcgtctaggtccagcccggcgcgggccagtgccccctcgaacgcggtccacaccgcccgcgacgcccggcgcagattgcgggctcccggcgagtcgagcccggtggtgttgggcgggaacgcggcccgcatggcgagcaggctcagctgcggcagcgagtcgctgagcagccggatcgcctgcaccggcagcacacccagcccggtggcccggtcgagcagccgggcggccggcaccggacggtcgtcgtcgagcgccgcggccaggtcgcacagcacctggtggatggcgacccagctgtactcggtgaccaggtgcagcacctggaagaaccggtggtcgggatggtgcagctcggcctccggcaccagcgcggccagcgcggtggtcaggcgggtgtcctgttcgtagttgctgccccggtcgtactcgtagcgcagcagtggatcgggctgggccgggttgagcagccgctgggcctcgcccggccgcccgtcacgcgacgtgcgcaccactcacctccgcggcggtcaccgtcaggtccacgccgagaccccagaacaaccggttgtccaggcagtccttcaggtacgggaccccggcggtgtagccggaaccggtcgcgtcgccgagcatccgggtggccaggctgtgatgggtcgacttccaccgctggtgggcccgttccagccgggtcagcccggcgtcgacggcgagctgctcaccggtgccgaaccggcggtcccggcgcgcgtccaggtatgcccgggtgatcgtgtccggcccgcgccgggcctggtcgagtacgtccggcacgttgccgaacgccggtgacatcagccgctcgtcgcggggcgtgccgcaggtcagctcgaagcgcttgtaatgctcggactggatcgcgctggccccttcggtgaagtcccggaagtgccggaacgcgtccgggtccatggtggccagcagggtgaacagcagcccggcgcgctccagcgcggtggcggcgtcgtcgagatgtgcacaggtggcgcccgcgtcggcggcgcgcagcccggtcagcgcgtgcccggccgacccgaccagtcccgtgaagatcgtctcgtagctctgcagcacccggatgaacaggtactcgtcgtgcagcacgtgcacggggtgaaccgtcatggccaaccgttcccggaccagcgggcaggggctgaccggcagcgaggccagcagctcgtcggcctgctccggcgctgccgggtcgaggtgccgggcggccgggacccggtcgctgtgccggtccaggtggccgaggccgtggtgcaaccgcttcttgacggtccgcagcggcgggcggccgtggggcagcaggtcgtggcgcccgtgcagcgcctccagctcgaaacgcatcacgtcggcgatcagcaggccggccaggtcacgggcgctgagcaccgcgtccggcccgtcgaccaggccgcgcagcaccggcaacgacagataggtcgcataccggtacgtgccgtcgtgtttgtcgagcaggcagtcgaggaagcgcagccgcaccccgccgccggcccggcagaactgccgggtccggtccagctcttcgatcagcggtgcggccaggtgatgcttcccggtacgctggacgtgctgggtgacgacttcatacgggaactccgcgggctgaccggtcacgcggctcgtccgccacgagcgaagccggcggacgacgtcggcagagctgggatcgagccaggtggaacaggtcacgaccgacctcctttcagtcttggcagttcgtccggcgcggcagttcgccgccggtatggagatcgtctcgtcggtggccgccgctcgacagtgggctgttccggccagcggcggcggtgtcccgatgtggccgccgcccggcgaccagcaccaccaacgcaaagtggatcaatacgtgtattttcctacgcgtgatccgaagtgaagacagccttctggggctcgacccggtggccggtgccgtctaccggacgctcctggcgaaccccgatgcacggctccaccagctcggtacgaccgtgggcatcaccgatgagcaggcgcgcgacgcgctggaccggctcgccgagttggccctcgtgcgacgctcggaggacgacgaccaagccctgccgctgctgaacgacccgccggccgcgctgtccacactgctggcccgccagcaggtgcggatggccgagcagcagctggagttcgagcgcaacaaggccgcggtcgccgaactgctcgcggcgagcagcgcagccggcgctgacctggagcccaacgaggtcgagcgggtgctgggcctggacgcgatccgccggcggatcagtgagctggccagctgctgccgcgaagaggtgtggaccttcaacccggacggggcgcagtcggcgcagaaccgcagcagcgcgcggccgatcaacgagcagaccctgcagcgtggggtgcagatgcggtcgatctacctggacagcattcgcaacgaccagccgaccttcgaccacgtgcaggatctgatcgacctgggtgcggaggtgcggaccacctcgacgctgccgatccggatgacgatcgtggaccggaccaccgcggtcgtgcccatcgacgaccgcagcagcggccggggtgcgttgatcattacgggccgggggatggtggccggtctggccgcactgttcgtctcgacctggcaggcggcccgcccgctggcacaccgtaagacccgcgagccgggccagccgagcgagcaggaacgcgcggcgctgcgcctgtgggcgcagggcgcgaccgatgcgagtgtcgcccgtacgctcggggtctccccacggaccgtgcgccggatgagcgagaacctggccgagcggctgcgggccaagagccggttcgaggcgggcgcgcgggccatggaagtgggctggctgaccgccgccgacttcatctgaggggccggaccggccctacaacgatccggcgaccgccgacggcaacggcacgatctccgccagcacgatcgtcgggtcggatcccacgacggaggcgatggcctgccgcacccgttccacgacggtgtgctccgggtcatcggccggcgagccgtcgagaaacatcccgatcactcgccagccgtcgcgttcgccgagccagaggtgcacgatgccggcctcgggcaggcgccgctcgagcacctgggccacccggtcacgcgtcagttcaccgtgagcggggaaggcccaggccgcgatcagatacatgggttactgccagccccagtcgccggtgacggtcaggccggcccggagcacctgccagccccagtcgccggtgagcttcatgccggcgccgagcacctgccagccccagtcgccggtgagcttcacgcccgcgccgagcacctgccagccccagtcgtcgctgaccatcgacgcgacgacgacacgaatgagttccatgctttttctccccggcttgtgtgtcaccgagtctgtggccgccgtccgacgccgggtagcggtctgttgaggacatggccgttttcgacctgccgcccccgcgccggccgccccgggcccggcgcgctgcggtgaccccccggacatcgcgagagaagcgctccgtcaggccggcgccggggatcagggtgtgcggtcgccctccgacatcggcggaggcgacccggacaccgtaagccggcgccgcatccggtcgataagaccggtgtggcacaggtgcaacagctcgtcggcataccgatgtcccgggtcgccgcgcgggtgggcgccgcgacgatagttctcactgcgacggtggcggtcgtcaccgccgtcgcggccctgctcggccccggcgtcccgatcggccgggacagctcgttgtacgtcctgtacaccctgtccgtcatgctcgcgagcgccgcctgcctgtgcagagccgtggtgacccgtctggaacgcccggcctggatcctgctcggcgccgcgctcctgctgtgggcctgcggaaacgtctacgcccaggtctggctgcggcacctggacagctacccgctgttgagctggggcgacgctgcctggctgtcctggtatccgcttgtcggcgctgccctgatcatgctcatgcgcacccggatctccgcagtgccccgcaacctgtggttcgacggcgtcatggtcggctgcgccagcggagccgtgtacgccgtcgtggtcttcggcggacggtcgaccgctacgaaaggttggatcgacctgctcgccgggttcgcctatcccaccggtgacatcgtgctgctggccatggtcaccagcgtgctgatcgttcacggctggcgactgcacgggggatggggctggctggtggtcggcctcgccggaagcaccgtgatcgacggcggatacctggccgagcaggtctcggaccggctcctctacggcacctggccggtggtggcgttcgcgttggcccgttcggcctggcagcccatgccccgggtggagcaggtgaaactcaccggtcggcggatgttcgccgcgccggccctgtgcgcgctcgtggtgctggccgtcctgctgcacgcggtgtatgcccacaccaacccggtcgcggtgtctctggtgacggtcagttacctcacgctgatggcccgggtaggtcttctcttcgccgacgtgcgacgcgcgcagacgttgctggaagcggcacacgcggcggccgatcagctgtcccgcaccgacccgctgaccggtctcgcgaaccggagggccgtcggcgccgttttcgaccagacgcgcggaagcgggcacggcgtgggtgtcctgctggtcgacatcgaccacttcaagcaggtcaacgaccggtacggccatgaggccggcgatgccgtcatcgtcgcggtgaccggccggatgacccgcgcggttcgccgcggggatgtggtcggccgctggggcggcgaagagttctgcgccctgctcgacgccatcccggatctggaagtgctgcgccaggtggcggagaaggttcgcaccgcggtgtgcggcgagccggtgctgctgccggacggccaccgtgtcgacgtgaccgtgtcggtcggcgccatcctgatcgatgacctgacccccctcgacttcgccatcagcgccgccgacgaacggctctacgccgccaagaacgccggccgcaaccgggtgcgcgccagtgtcgcggcgccgtacgacgccccggcgtcgcaggcgaactcaccggcgtaagcgcgcgcgtctccacgagtactgtgctcgcgccggcgctatcggggcgacccggaagcgtcctcccagcgaatgcgtgcccgcggctgccagccgtggtgtcgcgccggtcagccgccctttcctcggacggtcactgtccggcggccgggactcgaccggcgctgccgcttgccggagagccggcggtccgctcgaagatcagcggaggatgcgggcaacgttttcgatcttgcggcgcactacaggctgagcgctcgctccggcgcgatggcgtttcctgccatcccgcccgaagtcctaccgtgaggaacctgtcgtggccagcaaccagccggatcgagacccggtccggactgcacgtccggtgacccccgccgaactgcgtgacctggcagcccgtgccgaacagctgggcgccgacatcgaggaggcgttgtcccggctgacggctgccggcgacgaagccgtccaccggtccgggattcgtctgcactacgccaccaaatgggctcgccgggccggtgccggactgcatgccgccgccggcgaggtggcgcgcatccgcggacgcagcgcctgcccccatgacacgggtgtctgccccgatcacggcgccaccctgcgcggtgccgacggcgtcagctggtgcggccaccagggctgtggccggcgctggtcctacagccgccagtcattgccctgcaccgaaccggtcatgttcctggtgggcacccctgacggagcagagcaaccgacatgcgtcgggcacgcccgcgccgcgcgcctgcagctgtgcgaggtgaagattcttccactgcggatccgctgaaccgggcatgacggacgatggccgatctcccggcggtcgcggcgaaggaggtgtcgaaggatccgcaaccggctcgccacccgcgatgcctcggtcaggcggccttcggcgtgacggccgccacccgggcccggctgcgtccgtgcgccttcgcctcgtacagcgcagcgtcggcccgggcgaccagttcctccacggtctccgtgccgtgcagcgcggcgacaccggcggagaagctctggccgtccgggaccacctcccgcagccgctcggtcagcttcaccgcgtcaccgggcgacgcgcccggcaggatcaggccgaactcctcaccgccgtagcggtacagcacgtcatcgcggcgcagcacgtcccgccaggccgcggcggcgcccttgagcagccggtcgccggcctgatgaccatgagtgtcgttgtagcgcttgaagtggtccagatcgagcagggcgatcaccagcgttcccccggcgtcgtgcgcggcggtgaccgcgtcgtgcagccgcgcgtcccaggagcggcggttgccgacgccggtcagcgcgtcccggctcgccaggtccgacagttcccgtgcctgccgttcgacctcacgggtcaggcccaccatgcgggcgaccacgagcaggaacagcacgacgcacgccaccccgatcggcacggcctgcacctgccggccggtgaacgcctggccgagcagcagggccggcgggagcagcgacagcccggccaacaccgtcaggcggccggtggtcaaccgcggcgcgggcgccgagccggtcgtcgcgagggccggcatcgaggggtgcagggccgccgcgccgaaggcggtgtagccgaggcagtacagcactccgccccagtagctcgccagcgtgccgcgctcggccagcaccgcgttggccacgtccccggccagccagcagcagaccgcggccagcagcaggtacagcgacatgctgcggccgctgccgctgaccaacaggcgggccagcagggtgagcagcaccgcgtcgccgatcgggaaggcgagccggaacaccaggatggccaccggctgagccggctcgtcgagcaccggcgtgacggccaccaaccacaggggcagcgccagggagcacgcgacgatggccgaatcgatggtcgcaccccggtcccggccggctgagcggttgtgcacgatcaccgtcagaccggcggccagcgccaggtacgacatcaggtagacggtgctctcgagcaggaccagggccgcggagtccgggaagacccacacccgcaggcccagcacggcatcaccggtcaggttgatctgcaccgaggcccagaccagccaccatgcccgcgccggccgcggccgttgccggcgcagcccggtcagcagcgccgccgaggcggcggcgccggccatcccgtacagcacgctctgcgacaccgggccggtgagtagaaaacccagcgcgagcaccagcccggccgctacaaaaccacggcacgcccaaggccccatatgcttctcatcgacttcggcgtcgctcggatgagcgccggcggtaggacatttcccaccgcgccgtccctcagacgtccgtcgcgccggaccccggtccggcggcggacgccaggcgggcgagaccctccagggcgtcaccgctgagccggcacaccgtccagtcgtccagaagctcggcgccgagcgcacggtagaagccgatcgccggctcgttccaggtcagcacccaccactcgaaacgctcgtagccgtgccgcaggcagatgtcggcgagcgcggcgagcaacgccttgccgtggccgccgccgcgcgcgtgcggccgtacgtagagatcctccaggtgcatgccccgcgtcccggtccaggtcgagaagcgcgggaaccacagtgcgaaacccacgacctcaccggtgtcgtcgtcctcggccatcagcgagtacgccgcgggatgcgcgccgaacagcgcctgccgcaactgctccggggtggccttggcctcggcggcggcccgttcgtatgcggcgagctcccggaccatcgcgtggatctcggcgacgtcctgcacggcggcgaacctgatcatgaaggtgatcgtcagtcaccggcgaggccctgtccagccgcatcgcgtactcggagccgggtgaacgtcggctccggcggctaccgcatgcagtaggtgccgcgggcgtcacccgccccacggatggatcagtagcctcgagaggtggcattgcacgtgcagacggacctggatgaggcgatagcgacgttcgaccgccgtgcggtcgagtcccgggtggcggcagccgatcagcgggcggaggagatccgaacgtcgtttccggcgaccgagtggccgtcgctcgccgcagagcggtaccttcggctgggggcacacggctgagtgccctaccgtcggatcgagcggtcactgtctgcgggcagcttgattcgccaggtggtacagatccctcgcccggttgatgtcgagcgacatgccgtcgttcacggacaggaagtagccgagttgccatccttgcgagttgatggcttgacgacttgtcgtgatcacccagggcggatatacgcggaagccgcgcttgcctccggaatggttgttcccggcgatgccgcgttcgcagagggcgtccatcggaaagacgaataggccgaagtgccgctcgggtcgtacaccagtgttttcgcggcgcgaagatcatcgtgcacagggtcggtgatgatccactcgtcggtcgctgtcggttggccgtggattgtcgtggcccgccgcaatggtgcactcatgaccggagaataacggccagccggccggcggatgggccggcgaaccctgagcgacggggcggcaccgaccgccatgtcggcgatcctcgcgtcaatcggcggctgcgtcgctgatgacgtcggcgtagagcgggaacaggcggagccgctagccggtgagggtccggtccacgatcgagcaggcgtgtccagcaccgggcggcgaggcgccgggcgtgggtgccggtccacggctgggggagcggtccggacggcaggaggttcggatgcttggcgtgggtggactgagcggcccatcgacgtcggcggttccccggcatcgatgggccgttggcgtctgcttcatatggtggagcgcatgcggaactatctccggtggatggtgctcggtaccgttgtggcgatatctgcgctggctggccactggatcttgggtgccggcaccaaagcgcggtatgagcccgagccccttccgacgaacgtcagtgcgatcatggcttcgtacggctacaagaaaagcggggacaactcggagagttataccggccgcatattgggcgcggagcattatttctactgtcccactgaccaggattgcaacacggcagccggcaatgccgcacatcctcccgtcgacatctacggtgctacggctgtgggtgtggaagtctggtggccgccggcgcttcccgccaaggacagcccgctggcgggcaaacgcctgaccatctgcacgtatacgccggaggcgatctcttcggcacgtatcaccagcgatgagtgggccaagaacatcgcctcgctgtcccaggcggcgcgaggtctggtcaccgagaagatggcggcaagcccgcaacgcctgccggcggctccggaagatgtgcaagccattcccgtgaacgggtggcaatgcctggtgccggcgggggtgcggccgtttcggtgagcttccggattcgccgggggtacatcgccggccgtggctcgatcggcgtcgacgtgcccggggccatggtggctcccggccggagccggcaccctcgacgggcggctcagcagtggcggatcttctgctgacgaccggcgcggagcaggatcaaataagtcttaagtggtgaaccttcctgggagcgctcccgtaatgcctgtcgtaggcgtgatcgagaggctgcaggttcatggacagatcaaggattacatccgggctcagccggttcaagggccgctggcaggtcggtgccgtcgccgcggtcgccgtggcggtggccggcgtcgggttgggggtggccttcgccggcgagaccgtgccgaccgtcaactgcccgcaggtccggctcaccgtcgccgtgcccgcccagcagcaggccgacgtgcagcgcaatctcgtcctgctcaacacgcagatcgatgaggcgaaccagcggctgcgcacctcggcggggcagggcggccccaacttcatccagaacgccatcctgggcccgctgcgggacaagcggttcgccacgatcaaccggatcgagaccgcgatcggccggaacgccccgaagccggatttgaacgccgagggcctctcgggctgctcgctgaacaagggcggcggtgcgtcgaagaagcagaacaccgcgcccccacaagccccggccgcaaagccgaccaccgcgccggccagcaaaccggcggccgccaagccggcggccaccaagccggccacgaaggcacccacgccggacgtgcagacacccggcggatcgcccgtggcgatcaacggccagctgagcgtctgcggggtgcacctgtgcaaccgcgcgggcaagccgatccagctgcgcggcatgagcagccacggtctgcagttcttccccaactgtgtcaacgccgactcgctggccgccctgcgcaacgactggaacgccgacttcatccgcctgtccatgtacgtgcaggagggcggcctggaaagcgacccgaccgacttcacgaacaaggtcaacggcctggtcgaccaggccacgaaactcggcctctacgcgatcgtcgacttccacatcctcacgccgggcgaccccaacttcaatctggcccgggccaagaccttcttcgccgatgtcacggccaggcacgccggcaacaccaatgtgctctacgaggtcgccaacgagccgaacggcgtcagctggaccgcgatcaagtcgtacgccgagcaggtcatcccggtgatccggaagaacgcgccgaacagcgtcgtgctcgtcggcacccgtggcttctcctcgctcggcctctccgacggcagcgacgagaaggagatcctcgccgacccggtcgccttcaagaacgtcatgtacaccttccacttctacgccgcttcgcacggggcggaccgccgcgctgtggtggcccgggcagccaccgagcttccgttgttcgtcagcgaattcggcagccagacgttcaccggggatggcaggaacgacttcgccagcaccaccgcctggctcgatctgctgaaagccaacaagatttcgtacgggatgtggagtctttccgacggacgggagagcaactcggtcttcaaacagggcacctgcgccggcaccaccttcgcgggcaccggtgtgctgaccgaggccggacgctacctgcgcagccgcatccgcaccggggtgggcgatccccactgagcacggcagcggtgatgccgggaagctcggcggggtacgtcccggccgaacttcccggcacaccggcattcgccgggcgggtcggcgctcagcggtagccggccgccgcggggcccggaccggtgccgaggatgccggcggcgagcagcacgcccgtcgcggtggcgagagcggggcgaggcgatcggcgggtcatcagctccgtgtccatttctggttgtcgccgctgttgcaggtccagacgatgaccgcggtgccgttggccgtcccggcgctgctggcgtccaggcagagaccggactgcacgttggtgacggtgttgtcggcgttgagattccactgctgcccggtcgccccgctgcagtccgcgatgacggtgcggctgcccgaggtgcccgcgtccaggcacttgttgccgtacacctgaagttgtcttccggtggtgcgggtccactgctggttgacgccgccgttgcagtcccacaacgccagttgcgtgccgctggtctgcgcgttgtcgggcacgtcgaggcaccgtccggcgttgacgttgcgcagcgccagggacgtgccggagccggggccggcggtgatccgcaggttgtcgaactgggcggtctggccttggccggtgccgatcccggcgagccccgtgccgaacgtggcgtcatcggccgtgccgaccacggtgccgtcgacggtggcggtcagcgtgctgccggagaatcccagggcgacggtgtgccagcggccggtgccgagcgtggcggtggtgccgctgcggaccgtggtcgtctgcgccgaggtgttggtgcgcaggatcgaccaggcgccgctgtcgctgacccgcaggtggtacgcgttgagcgcgcccgggttcatcaggtcctgcccgccgacgcggcccagcagttcgacgtgtccggagcgttccagcatgacgtcggactggacggtgtagttgctccaggcggtgttgccgagttcggcgtacgggtcgctgagcgtcttccaggtgatcggcgcctgggtgccggtctgccggacgcaggtcccggaacgtccgccaccgcacgcggccgcctcgaacgcgccctgcatgtccatcaggtaccgggcttcccgcccggcggggtaaccctcgaagtcgtcggtgtacggcaacgccagtgacccctgcccggggctggccgccgtgcccttaccgcccccggtcgtggtggtgacggtgtactggtagcccggctgcacggtcagcgagtagcgcccgccggacggcgtgatgtcgacctggcggacgaagaggtcggccgggttgttcgagttgaggttggacgcccagacgtgcaccgggccggtggacagcccgccggtgacggtgagatcgagtgtctgggcgccggaggcgtccatggtctcgatgacggtgctgtagtcggtggtgctcggcgacctcaacgtgacgtagctgccgttggtgcggttcccgccgaggtagcccgaggaggtgtccaggtacttccagcccggcgcggtgaactgcgtggtgtgcgcgatcgcccagacgtccttgccgaccgcgtagtaccccgaccacggctggttggccaggaccaggcccaccgtcgaccagaggttgttcggggtggtggcggcgaccaggtcccagttcaggtagccggtcatcctggcgtccaggtagacccggttgatgccgcgggccaggggcttggcgccaccgttgtagtcctgggagccgttctcgctggaccacagggacttgccggagttgatcgcggtgcccgaggaattgcaggtcgtctgatccgcgaggtagccgcaggagtagtgcacgccgatcgcgtcgacggcgtcgcgcagggccgtgttgccggcgaactggtcggccggtgagtaggtccagtcctcggcgacctcgagcttgacggcgccgtagccgttggcgttgagcgcgttgcgcacggcgatcgtcgtggccgcgttccactgcctttcgttctgcgcgggcaccaggtagtcgatggtcaggttgtgctgcttcgcgcagcccagccaggacagcaggtaaccggtcaggtcgccggagaggaacgtgccgttgccgatccagccgggcgcgccccacggcaggcccatcagcttgatcgagggattgcggcgtttggcttcctccatgatccaccactcgtagccgcggttgcagtccagatcgccccgggagtgcgcgtggctgggctcggcgccgctggtggagttggtgtcaccgccgatctcgaccttgaggacctgcagggcggcgccgtagccgggcttgaacaggtagtcgagaacctgtccgcgctgcggctcgggatagtcgatcagcagacggctgttgccgcctccgccactgaccgcaccgacaccgtcgaacgtccggcccgcggacgcgccgttcagcgtgatcgcggtggcggcctcggcgggtcgtgcgaacccgccgacgacgccggtcgccgccagcgtgcagcacacggccagcagtgcccgggggagcagtcgtcggggcgggggcgggacggtggacacacggcgccgaccggtttcagtgcgcatggggtactcccggggatggggcggatgccctgggggcgggctacacaatacgtcgtacgttaggacgtcaatagtccgaggtcaatggatcaataatggaggaagaactgtcccgaacgccttctcatttacttacccgacgtcgccgacttggcagtgaggtggcatataacactttcttgagaaacgtttttaaatgaaacttttcgatgtccggactgttgcatccgggaagaatcggtgatgatacgtcacaccaatccagggtcgtcgaggcgtcgatcaccggttcgcccggaaccatccgcctcgccccgggcaccatggcaaaaggagtcgtgtaatggtgcggaaaagactcgccgtcctggccgccgtgatcagtggggcactgggcctcgcccttgccggcgccttgccgagcgacgcgttcgccaccagcgccgcggcgccgacggccggctgcggccaggctcccacgctggccggcggcacccacacgatcagcagcggcggtcagaaccgcagctacatcctgcggattccggccggctacgacggtaaccacccgtaccggctggtcttcggcttccactggaacggcggtaccgccggggacgtcgactccggtggcaccgacggctacaactggtcgtactacgggctgcggcggctcgccgacgccgccggcaacggcaccatcttcgtggccccgcagggcatcggcaacggctgggccaactccggcggccgggacctcaccttcgtcgacgacatgctccgccagatcgagggcggcctgtgcgtcgacacctcgcagatcttctcctcgggcttcagctacggcggcgccatgagctacgcgctggcgtgcgcccggccgaccgtgttccgcgccgtcgcggtctactccggcggcaacctcagcggctgcatcagcggcacccaggcggtggcctacatcggactgcacggcctgcgcgacaacgtgcttcccatctccagcggccgagccctgcgcgacaccttcgtccgcaacaacggctgcaccccgcagaacccgccggagccggccaacggcagcctcacccacatcgtcaccacctactccggatgccgcgccggctacccggtggtctgggcggccttcgacggcgcgggccacgatcccggtcctcgtgacggctgcacctgcgacggctggcagacctggacctccggtgtggtttggaccttcttcgcccagttcggcggcggcaccccgcccagttcgccggcacccggcggcgcccggcagttggtgggcgaacagtccggccggtgcgccgacgtgccgaactcctcgaccgccaacggcacccaggtccagctctgggactgctccggcaccgccggtcagcgctggacctggacctccggtcggcagctgcaggtgtacggcaccaagtgcctcgacgcgaacggtcagggcaccgccaacggcaccgccgtgatcatctgggactgcaacggccaggcgaaccagcagtggaacgtcaccgcgaacggcaccgtcaccggccagcagtccggactgtgcctggacgccaacggcgccggcaccgccaacggcacccggctgatcctgtgggcctgcaacggcggcgccaatcaacggtggagcctgcgcggctgagcgatcggcgtcccccatcccccggtgaggaaaggtacgtgtcacgacccggagtgtcctcatcgcccaggcggttcctggccctgagcgcggcgacggcgctggccgcggctctcggagcggtgtccgcggcagcacccaccctggccgcccccacgaccgtgtacgcctcgcccaccggcaccggcacgagttgctccagcgaccagccgtgctcactggccggtgcgcgggccgccgtccgatcgctgaacgacgcgatgtccgacgacatcgtggtgcagccggccgacggcacgtaccgcctctctcctgccgcatctcccgcatcgcgtccagcacgtgctcgatgcgcgccagctcctccggggtgtggtgggcggccaccgcgccggccatggccgactcgaggttgccccggtgtcgtcctggacgagtgactcccggctgtctgccggcgcggtaccgagcgatacaacccctgcttcgccattacttgacagccgaacgggtggtttccgcatccccctctggtggggatgtaggggctacgcccggcgatcatcggatcgtccgggcgcagtagccgaccacagggagtacccggatgactgtcatcgttgacaccgctgcccgcgccgacgcgtcggcgagcaccgaccgggccagcgagttgatcaacgccatggcggtcctgccggccggtcacccgtcccggcccggtctgcgggagcgcgccatcgaggcatggctgcccctggcccggcacctgtcgcagcggtacgccaaccggggcgagccgcgcgacgatctgtaccaggtcgccgtcatgggactgatcaaggcggtcgaccggttcgagaccgatcgtggcgtcgacttcgccggtttcgcgatcccgaccatcgtcggtgaactcaagcggtacttccgggacaagacctggtccgtccgggttccgcggcgtctgcaggaactcaggctggccatcaccgcggccaacaacaccctgtcgcacaccctggggcgcgccccgacggtcaccgacatcgccggctacctcgacgtcagcgaggacgaggtcatcgagggcctcgaaggggcccgtgcctacaactcgacgagcctgtcgacaccgatgagcgagagcggcaccgagctcggcgacaccctcggcggccccgacaccgggtacgaggaagtcgagcgacgcgtcatgctcggcccggccatggcccatctcgacgagcgcgagcagaagatcgtcaccctgcgcttctacggcaacctgacgcagcagcagatcgccgagcagatcggtatctcccagatgcacgtctcccggctgctgaccaaggccctggccaaactgcgccgcaacctcgacggcgccacgcgctgaccaccgcactcgtgccgggcggaggccgggcctcagtggtgcatgacggcgtgcgggaactgtagccgtaccgaggtcccggcgggcgtcgcgtcgatgagcacgacgtcggccagctgccgggccagccacaggccacggccgccgggtgcggcgctgccggggtcgggacggtgatatcccgcggtggcgggcaccggaaggccggcggagtcgtcgcactggacgatcagggtgctgccccggtgccaggctcggacccggaccgcggtgcccgcatggcggagcccgttgctggcgacctcgaccacggcgacgacgagatcctcggcgggatcggtggcgagaccgaggtcggatgcccagccgtgcagggccgagcgcaggctgccgaggtcggccgccgtggccagggtcaggtcgtggtccacccgctgcggcacctcggggagcggcagtggccgccggcccagcaggtagtcgtccgcggaacggaagtgcgggctgggctgccggccgtgcggggtgagcaggtagcggtgggtggcccgggcgccgtcgaggatgcccgccgggtggtgccggctgtcccagatgcaggtgacggcgcagccgtacggtgcgtaggtgtcgttgcagaccgcctcgtacgccaggtaggcgtcggcccggaccggagcggcgcccgggtcgagatggtcggtcaggtccggttcggcgatgacatggacccggcgtccggtggccgcccgttcggccaggtgccggcggaagtcctcgtaggcggatccgagccgctggtagtacgcggcggggtcaccccaggtcagcaggtcggtcagcggccgcaacggcccggtcagcagttgccgggtgcggtcgctgacgacaagcagcacctcatcgaggcggtgcgcggaccggtgcagttctctcaccagggtggtcgtcagctcctcgtcgctacccggaatcagcgcgctgtgcaggaacgtgccgcctgcatggtcgtcccggtggtgcgcgatcatggcgtgagggtattcatgatcatccagtaggcgcggctcggtggagcaatcgtgcgagaagacatcaccacaggggcaggcgatacccgccaggcggcaagctatgcgccggtacgacgcggtcggtgacagggccttgacccatggtgacctgatgccggtgcggtaccgtttcccagcaggcctaccggatcaccgtcgacgggcgcagcgaggtcgaacgcggtggccgacccggacgtcaatatgctgccggtatggatccgtcggtagaggtggcgctgtccgggatgctggcggccgccgaggacgcaaccccggtgaacgcggtggaggccgtcacccgggaactcgggacggcgctgcatgccagcagcgtttccttcctgatcgctgacctcagcggccgggccctggtccggctggcacacgtcccgctcggcccggcgggcggccgccgtgacggcggcgaggtggcgacggtgctgccgttcgacggcggcccgcaggaggaggcgctacgcacccaggcagtgcaggtcaacggcggcgacccggaatggaccgtgctggcaccggtcaccgaacgcggcgaggtgatcggcctgctggagatcgtcgtgcccgccgagcccgcaccccaggcgctcgcggagatcgaacggaccgcacacgccctcgcgttcgtggtgatcgccaatcgccgccacaccgacctgttcgagtgggggcagcgcaccaccccgttcaacctctccgccgagatccagcgacgactgctgccggccgccttcacctgcgaaggtggctccttcaccctgtccggctggctcgagccggcggcgagcgtcggcggggacaccttcgactacagtctggcccgcgacaccctgcacttcagcgtcaccgacgccatgggccacggcgtgaccagcgcactgatcgccaccctcggcgtggccagcctgcgtaactcccggcgtgccgggcacagcctcaccgagcaggccgaccgggccggtgccgcggtcgcggagcacgccccggcccgcggtgccttcatcaccgcggtcctcggacgcctcgacctcaccagcggccggtgcgacctggtcaatgccgggcacgtaccgccgatcctgatccgcggcggccacccggaggagctgacgctgccccgcaacctggccctgggcatgttcccgaatcgccgagtcagcgccggcgcggtgaccctggaacccggcgaccgcctggtcatcgtcaccgacggcatgcgcgaacgcagagccgccgccctcgacctgacggcccggctccgatcgctcgccgccctgcacccccgcgaagccgtacgcgccctggccgacggagtcctcgacgtcgccggcccgaccctcgaggatgacgccaccctgctgatcatcgactggcacggacaccacggcaggcaacgccgcacccgcgccggcgccgacgtgtccgccgccacctcagccgacggccgctgaccgcgcagcggcgctcacgccgtcaacggcggcatgccggcctcggcggcctcgaccgtgtcatacacgtcgagcacctgatccaccaccgccacccgcagcacgaacgcgacgatgtcctgcaccgcggcgacgcacaaccgtccgcccctgccgtcaagctccttgaaccacaccatcacgacgcccacaccgctggaatcgaggaacgacacgtcgccgaggtccagcaccacctggacggcaccgccgtcggtgacctgctgaaggaagtcgtccagctgcgggctggtcgccatgtccatctcgccgccgaccttcaccacggtgcaggcccggccatcccgcgctgacaactgcagatccacgacagcctccgcaaaccgatgcgccctctggcaacccgtcaccccgataaccggcagcggtgcctgtcaacccacagcgctctccgcctggcacccgagcccggccgctgtaccgtatccgcggataccaggaacgcaagcgcgcccccacaggtcgggactcgctcgatgcacgtcggcggcggtcgctcatgccaggggtttgccgccggtgaccccgagcacctcgccggtgatgtagctggattcctgcgaggcgaagaagacgtacgcgggcgccagttcggcgggttgtccggcacgagcgagcggggtgtcctcgccgaacgactcgactttctccttgggcatggtggccgggatcagtggtgtccagatcggtccgggggccacagcgttgacccggatgcccttgtcggccaggttggcgccgagggctttggtgaaggcgacgatgccggctttggtggtggcgtagtcgagcaggttcggcgacgggttgtacgcctggatcgacgcggtgttgatgatcgtggaacccggtcgcatgtgcggaacggccgccttgctcagccagaaaatggcgtacaggttggtcttcatcacccgatcgaactgctcggtggtgatgtccagcaggccgtcgtcctgcgacatctggtacgcggcgttgttgaccaggatgtcgaggccgccgaggtcgttgaccgccttcgccacgatggtcgcgcagtgctgttcgtcgcggatgtcgccgggtgcggtgaccgccttgcgaccggccttctcgatgagctgtgcggtctcccgcgcgtcgtcctcctcctcgggcaggtaggagatcagcacgtcggcgccctcgcgggcgaaggcgatggccacggcccggccgattccggagtccccgccggtgatgacggcccgcttgccgtcgagccggccggttccgtggtagctgtcctcgccgtgatccggcacgacgtccatctcaccggtgatgccggggtgcgagatccggtcgctgtcctgcgcgtccggcgtgcggtactgatcctgggggtgctgaggttcgtactggttgtcgggcacggggtgccgccttcctggtcgatgagaaagatggcttcccgcaacgggccgaagtagtcctcagatcacgatttatcgtatttgctggttcgtttggcccgcccatgacgccgcaggtgtcatgggcggcgccgtgatgaacaggatgccgccaagaacggtcatctccaggagaggccgcgagccccgggcccggggccggcgacacgtcaccaccgacggacgacgtcctccgcctcaatggccagcgagttgccgtgcaccgcggcgcgctcgcacaggatcgtataggcctcgccgatgctgtggtatgcctgaaaggcccgcgccacacccaggccctgctgcggctgtacgcgctacaggacatctgcgggcgcgatcgtgtcgcccgttgccctggatcaggcgcccatgatctcgactacccgccgacgcgattcgtcatcaccgcggtgccatgtcatggacatcgacggccacgttcttgggcccaccgagagctcggcaccaggtcgagcgggcgcacgcctacaccccgatgtgtcgatgacgcaggactggcagccactcgcatgcgggcgatgctcgactgtcggggaccacccggcggtactgacccggtccgggggcgcgcttgccccatatgaagaggacacccttgccgatctgatttcccgcaccgctacggtgaccaatgcattcgtcaatctacccgccgttgacggcgtgcagaggcgatcacgctagccgatcgcactttccgtagagccagcaacgcagggtccgggcttcaatcggataatgcctcatctgggcgccgttctcgaaagttgaggggtgggccatgtccgataccagcgtgatcgtgagagaccagatgaccgggacgttcagattccgtctggagctcggtcgcgacagcaacgaggtccggatgcagccgcggcggttcggattcgtcacggagaaggccgcgaagatggtgtatgaccggttgtgccccagcgtgatgcccggcaagcgcggccgcggaatagatgcaccacgcaggtggtcagtgcggggtggctgctgtcgtgggagcaggaactggagccgaacagcagttagagcaacggtggttgctgggtttgctctacccgtacgtcggccgggttcggtctttccggctccgtgcgcggatggtgaagcgcgcctatcgggacctggaggccgaccacttctcccggaccatcttgcgtagcgatgtcgttctgtccggatctgcatttgaaacgacacggcttgatgttgcttagcccgattggttgatcacgcctagggtggagaccgaacgcaagtgccccagcccgcggagagtcgtcacgattgcggtgaccgccgtctcggccagcagtcggatttcgcctggaatcggtcgaatgtgcatgacctcattacgggctcgaatgactgcctcgctgcggcgttgccaggcgcctctcgtttccccgaggaccgcctcgaacagatcccatcgcaccacgataatctggaaaaggtcgttcgggttcaggtagtcgatggtgtccagtgagcagtcgacgacgggtctgtagcgaccttgccgggatcgggcgtcgctgacgatcttactgaaggaagcgggcagcaggccgagactgtcgccgtccggagcggcctctgaaaggactgatcgaatgaggcgccgcaaacccacttcgcagtcgagccacaagctacggaaatcgcgaccatcggcgatcgagagcagataacgaccgaattcggcagagaacggcaccagcgactggtcgtccgtctcgacgacgagaccgtagcggatcagcgcaagggcgtcgtcgatagagacgtcgaggccgataccgtcaatgacctgatagagcttgtcgacacccgaaccatccaggtcggcatcgatgattcgaataaggcgagcgaagaagtcggcgtacgcggagcgcacgttccggtacgccaagtcggtgtcgcccgagctttccaccagctcgtagcagagaagctctaggaggtacggatgacgaccggccacgcttgtgatccactcattgtgtcgctcaaggtcgacccccgccgcgcgagcccgccgaaccatcgcattttgttcgacaggctcgaacagattggtgtacgtgcgaacagccaacacctggtcgagacaggacccattggtcgagccgagctccagtgtcttgacacgctgacgggagacggtgacgagaccggtcgaggaccaatcctcggtgcacaggtcacgcaacaattggaaatgcgcagtctgaacgccggccaggttgattcgatcaaattcgtcgaggacgaccagcaccttcaggcggcgttgatgaatggtgctgaaaagcttgatgaactgactcatgatgccgtaccaactggactcggcctcgagcgcgttcagggtggccgtaaacccggccaggtcgcgtgccggcaggccgtcgagcgcctccacagtggcgcgtccgatcagccggaagacatcctcaatccgtccgaccttgccgatcccgattagtacgacggcgagatctggccggaccgccgggatgtcgatcaggctacggtagatcaagctggtcttaccggtccgatggttgccgatgatcgacatgttcgacggccgatcgccttcgacgatgccgcgcactcgggcgaccagatcctcgcgcccgacgaagcggtcgccccgagccggctggccgacattctgaaaggggttgccgccggtcatcaggccacccttcggcggagccagtcgtggtagagacgtaccaggatccggtaggcgcccgcttcctggacgacgacttcacgcgcctcgagatccttgaggatcgagaccacgttcggtacggaacacctccgttccacatcttcgatcgtcgctcggccgtcgttggcagcgaccgccaccgcggtgaggacttcgcggaccgcctccgtcgcgatggcggtggtggatggctcgccgctggtctccaggttgtcgaagtcgcccgggccaaattcgttgagcagccattcccggacaagttcgacgtcggcctcagtcaccagcggcgccttcgagctgttcatgtgttccaccagctgatagcagaatcgctggatgtagaacgggttgccgccggtgagacttagaatctgttcctgcgcccgctcccggtaccgtgactcgccgtcgggaccgccgatccggattggtcggtccatgagctccaaagcgtaccgtggttcgaggtagttgacccggcgtttgtcgaacacgccgaactcgttggcgtacttgtcgatgaatgattgcatggcgtcgaggccgaccaccacaaggtggaacaatcgctgctccaagaccgccttgagcgcctgaacgaaagtggacgagactcgcccttcggcaatccaggttgctatgaattggaactcgtccatcagcacgataaatgcccgatcacgccactcgctgtggcgcgcggcctcagcgttgaagcgctcgaacacggtgatgaagtcgccgaccgggaccctgctcgtgaggaactcgtcccggggcaggtcggccggcaggaattcgatcggatcgcccagcgcagcggaccgctgccgaacgacggcgtcggccttggtgagaatcgtccacagcaggatctgtagggtagcgtttgcttcgccgacactgaccggtgccaattgcccgatgttggcaacatcgactaccaggaaccggtcgctcttctcgagccgccgggacaggtgcagacgaatcgatgacttaccagcccgcttctgtccgtagatcgcgacgccagcgccgggcccggtcgcctcgaccagcagcgcctcaatctgatcgacgagttcctcgcgtccgaagaacatatctgggtcggtgacggtacggccggcggcaccatccttgaacgggttagggctgatcttggtgaagtcggcctcggacatcaggcgtacggcgagcgtcgcactgatccggcccttttcgttggtacgggtgcggtaagtgacgtcgatcggcaggctgaaagcgcccgatgcgaccagttccttgctcagctccacctggatcgacgagatcttggcgtcgccgccgcgcacggtcggcacggacttcaccacatcgagcaccttgatgccatcggccgcggcggcgaggttgacgaccaactcgggcgactccacgggcgcacagctaggctcattgtagagcttcacctgcacggtgatccggttgtgcaggtccggggtgtactcgacgagcgccagcgagagggtcgggtcgggctcacgatcggcgtagagccgctctaacgtcttgtccacctgagccagggtgcgggaggcgatcggcaacaggttccgaacggccagccgggtcggtgccgccttcacctgttcggcaaagtccctcatcgcgccttgtacctgcaggtagcggaactcgcgctcctcgaaaccgggctccttgagcccatactgcagcagccggaagttcgtctgcaactttcggcaggcttctcggtctaccgccagcgcgaccgtccgctcgctgtgcaggttgtccaacaccgtgaaggcgcgatcaagactgacctcgccgacttctaggccatgcaggagtcgcaactgctgttcgatctcgtcgcggtcggactgccggcgcagacctgcttcccgccacgcctcgattacccgttcggtggtcacatcgggggaccggagatccaggaactcggccaggtgccggcgggccgcccgggcaagcgaggggacgtgctcgatcgcacggatagccgactcagaggcgaatctggtgcgggctgcgagctcgtcgaccgcctcgaacagctgttgaacactttgctcgggaacttcccggaggtcgtcggcgagggcggcgcccacctcggccgccgacagactactgttgccgcctcggtcgtgggacaccgtgagggactccgggctgtcgaaaatcgaccgaaggtagcgctgcagggcgttccaatactcctgcatggtcggttgccggagctgatcggccaaggccagagcctcgaagtagatttccctggctacctcggtgttggttgacagcatggtgtcaccgagcgcggtgagcccgcgtagcagcagatcaaagaaagcttgagcgttacgctcagcgctttcggacccgccaccgtcaacggtggagacctcgagctcgattctcgcggccgagatgtacgcgtcgtacctctcccggctgcgcttgttgcgtgcctcctgtgctcgagtccgaaggtagcggatgtcgttagcggcaaacttgcgttgctgcctgatgccgtcggcggcctcggcgaaattgtccaggatgtactgaccaaagtcggagatcgcctcgaacctgatgtcggacaggcggcggaccagcaagtccaggtctgctgtgctgccgccctcgcgcatctgccggatcttgtccacgatctccagtgcctgcgcgtcctccttgctgcgcagttcctcgatgacctcttcggcttggtccaggtcgcctggttggtcccggcgcatcaatgcgatggcgtatgtgcggcgggccgacgcctccgacggcgcgacccgcaacagctcctcagcgtatggcgtggcgtcctgcgaaaggctgagtttggcctggcagatccgccgcaacaccaccttgcgctgccccgcctccaaatgtccggcgagcatcggctccagcagccgtaacgcgtcctcgtaccgctgggaacccatgtaaaagtcgatgaggatctgatctagggaggcgctcggcggcaaccgatcagcgaactcttcctcgattacctgtagagcggcctccggcccatcgaccctacgggtcagccacgccaggtccttgatcgcactctccgcattgatgttctttcggatcgcgtcccgataggccattttcgcccgctccaagtccttggcccggtgctcgaggtacttggcctggtcatactcgttccgctccgcccgtcgctggcgagtggccggcttggccggcggtggtagcggccgctgcgggggtggtgccggcacgattcgcggtgtcacgctctttgggttgattcgggccggcatatccagggacgggagtgtcggcaccgagaggacggccgcttcagggccgttctgcagcatcttcgcggcacgggccgcgagttccacatcacccgcactgctggcgaggctgtggcaggcctcaagcaccgaacgtcgtacctcgggcgtcgcctcagcctccgggcggatcaggtggagcaggccagcagcgcccaaccgttcgcacaatgccagcaacgcccaccatgcgtctggatcctcctgcggcgtcgtgccgtcgatatagcggatcagcccctgccgagcgatatccacccggtcggcgcgaagtgccgcgatcgccgtgtcgagccaccaatagggcgcgacatccgggacgatgagcgccgcacttagatagcggtcgctggccgtctgtagatggccagccatgtagtgcaggtagccggccagccggaaggccgagctcgaatgcggttcgccgagcaggatctggtccatctctgtggccatgctcgtgcaccggccgaagcgcggatcgagctctttcactcgaacggcgtactcgagctgctgtcggacgcggtccagtgcagcctcgtggctgtgcacgttgaacagctcgtcgttggcatacgtgacgaaatccggcgcggccaatggacgctgcataatgatcgtcgccgcgccagagggcacgatcaggcgcggaatgaccggcggtgcttccgggatgcgcgcagccggttcgaccggcggcggcaccgaggcattgggcgggatcggttccgcagcggtggccttctgcggctggccggtggtcacggtgattatgctggccagcgcgaccgcgtgcttgatcccggtgccctgctcctccactacgagatggctcatgctcagcgtggccaacgtcccagcgatctgatggccggtggtctggtacacatagatgaagtcgccgaccttggcaaccgcctgaacaaggtcaagatccacctttgtcctcattgtttcgggagcgggttgccggcacgaacgtgagtgccgccctgactgcgtccggaaatccgaggctacgcggatgttacggcctcggctatcatcgaacgggcgattccattccgtcaatcggacgcccgtcggtcacgtggatcgcgaaggtccagccgattgcaatgatcaatagctaagccctaccatatgccgatgaagtcggccgactgggccctgatcatttctgcggctgcgttgttgatctccctgggcggcacagcagcggcgatctggcaggctcgtattgcccggcacgcggcggaaatttccggccgagccgcggatgcgagctccgcccaggccatcgccgctatccaacagacgaatgtgctgagacgccagctttccgccgaggacgacgaccgcgctttgcgcgacgccccggaattcgttattgaattcgttggtgaaggcgagtggggcacctggcggacagaccgccgtggcggtcgccggtttgccgcgatctcgcggcacaacaacccgtcggtccatgactgggtgaagcggcgccagctagttctcgggcaccgacgcggtccggcggtgcgcacctcgatcgcagtcgacggccggcaaccgccagatgccgaactgctcgaccctggcccgttcgacatggtcgagggcgccagccgacggattccgatcgtcacggtgcacgcgctcgagggcgcggagttgaccgtggtgatcaccagcgaggagttgtccgggcagggtcgccgctgggtcagccgtcgcgtattggcactgtgacgtcaggagttgtgatcgcatcaggagatccgttccagccacggcgtacgtttgagccgcaccatcggctcgctgccttgcggccggtccagcaagctggaacggcgcagcactcgcagaaaccgctggcggtcgcggttgtcgtaaccgaagagaacctgggcgtcggcgtgctcgtctcgttcgcgcatcagagcgagcacctcgtgctcgggaacggcgacgccgacttggtccgccaggagattgccgagcgtacgcagggcgctggcaaccgagtgggccactgggtgagtctcgatgaccgtcagtgcatagccgtccgatcccgctgggatggcgtcgatgacgccgatccggcgggcatggtcgatgacctcgtgcgcggccttgccgcccttccggtctatgtcggcggcgatcggggttgaccgcagatcctggaatagccgatcgcgggacacaccctcggtgtagctggcgaatgccctccggttgatctcacagattacccgccacagcggctccagcagcccgtcggccgaccactccaggcgcgactcgaaccggccgtccgaccgctccataagccagcccacgtccttcatcgcgccgatgacccgagcaaggcgccggccgtcgtcggctgcgaaccggcctacccccaggtcgccgatggtcggcagccgtgcggcattgcctgtacgcctaagcacccagtccgcgtcttcgacgatgtccaggacggtcgcagacgcgaaattcaggtaggtgcgccgcagcacggcggggcggttaccggtgtcccgctttgctggcacggcgaccttacgggtatcgacccgagcgaactgctgcaggcacgcagtgtgctctacctcttcatcgcccggctgcagcaggccccaatccgcaagcatgcgtatattgcgggtctggtcgccgccgaggacaccgccggccatgcacacccggtagaggcttagcacccgggtagcggccgcttcggcgtccgactccggcagcggctcgatgtccaggacgtcggtgagcgacagcagcctgacgttttgctgggccgcgatgcgccgatactccggggagagcgtgcgcgtcgaggcgacgacgagcacaacctcggcccgggcctcgatcatgcggtcaaccaacggaatgaaatcctggtcgccggtggccagcagaaacagtccgggcccgccgcctggggcgtgaatgtgatccatcgccagcaccgcgagcacaagatcggcctgttccttggcggtgcgggtcttgtggatgcgagcaataaaggtgctggtgattgcaccttctacactgggcgcgaactgctcaccgacgaagtgagcgcgcaccaagtctggcgagccatgccgggcgcactcgtcacgagcgatcttgatcagatcgccgaccagatcggagccgaaggacaggcgctgattcttcaggtggatgctgagattgagccagtcgaccaggaggaccgcttcgttgatcgtcatcagcacaccattcgagtcgctacggaggcagcgcgcttattttggaccaagaagaccgggaatgaaaccctacgatcggctgaccgggattagatagctcggtaagatcaaaaaagaccatcggaaacctgccgaagaaaaagtaagccccgatgtaaatcgaggcttactacggggttcgtggctggattgtgcttgttggtgaccgacatcgccggtcgcaatccaccagccgccctcagtatctgcaacagtacgccggacttgagcacatcgcaaacgtcggtcgacggcctcagcgggatggcacatgggtacccccgtaggtcggtctcccattgcgcgcgctaggtgtagtgaccacgagaggtgttgacaccgcgtgactgcttgatcaaatagaagccctccggcgaggcggaagttgcgacggttcacccttgaccggaggtctctaaagccgaccgtaaagcccggctgaccgtgtatggctgatgcttgtcaatccagcgtctcgtcaccgaccggggccaggtcgcgcacatggtctaagagctcggcatgtggcgcccggtcgtgcccgggagtcagcggtctcggcgctgggtggcgagggccgaggggaagttgaggtccgccttcatcaccgcggcgctcaacggggtcgtcaggtcggccagccggccgcatccgtccgctccgatcgcctcgtaagggtaggtggccagctggtccgtgcgggcttcgagggatcggcgccagcgctctccttcggggttgagggtgaggtcggggccaggggcgagccatccccgcgcgcggagccggtcgatgcccgcgttccactgttcgtcgctccagaatcggctgacgcgcagcgcctccggcggtacggcaccggtggcggcgtgggtgatcagtgcctccggcccgtcgagtccttcggtgtgcagcagcgcgacgtggctgtccccgcggaactcgcggagcagcgtctgcgcgtgccagagcaccagatgaggcgcgcgtggccacgccagcgaggcgtgcgccgcgaacagcggccgccccgggagacggtcgcacgcccgctcggcggcgcggcgcgcgaggtcggcggcctcgcgtaccgcggaaccgccggtgtcgtcgccccaggcctggcgcagtgaacggtcgacggcctcgtaccgcgcctcgacgacctgtgccgcagtggcgatgtcccaggccgcgggaagggcggaccggaccgcgtccgggttgaagttgaagaacgtcgccacggtgacttccgcgggcaccggacccatcgcggccgaccgcggtgcgaagtacgtcatggcgcggcccgtcaggccgatgccggcataggtgtcgcggccgtgcggtgagaagtagatcatcccgtggatcggctctgcggcccggaacgtgagccgtgcggtgtccggcgaaacgtcgctcatgtgactcccatcgggacggagggcgaggtcgggcaaggcccgcctggttctctgccgggcgggcgggacggggaactcccgagggtgcggcccgggcacagcgacatccttccatttcgtcgacccggtgagccacctccggcgcaccgacgtcgaggccgccgcgccggccgtgggaacgccgtcacccgtcctgcgatggcccggaccggtcgcggagcacaccgtcgatgatgcccgccaggccccggtgcacgtggtcgccggcgatgagctcgccccactgctcggacagcgcggccaggtgcgggtactcctcggcgggcagcgtggtcagcagccgttggcgtcgcgacggctgctcgggcttgcgcgtgcccgcgttgatgaacagctccccggccacgaagctccacagcagctggtagagctcgaccgcctcctgccggtccaggccgcaccggatggccgcctccagcaggtgttcgacggccggcagggtcaccacgccgaccagctcctgcgacccgaggatctcgggcagccacgggcacccgtcgagcaggtggtgcaggtgcaccgccgcggccaggagatagtcgcgcggctcggccgggaagtgcggcagcggcgtgctctcggtcttggtcgccagcagcatcaacagcagcgcgtcgcggtcccgaacgtagtggtagagcgccatcggtgtggtctccagctcgcgggacagccggcgcatggacaggtgctgcacaccctcggcgtccacgatggcctgtgccctggccgcgatcatctcctgcgtgatccgggcggggcggcccagtttggcacggcgtggggggacggcaggttgcacggcgattccttccggtccgggggtggcgatagacttatcttacgcgtataacttgtgtgtaagaaaacgatgagggagtgcgcatggctcagttggagccgaagaggggcggggctctcgccgccgtcgccctggcccagttcatggtcacgctggacatgaccatcgtgaatgtggccctgccgtcgctcggcggtgacctggggttcgagccgacccagctgccctgggtcgtcaacgtctacgccctgctgttcggcggtctgctgatgctcggcggccgggccgccgacctgttcggacagcgccggatcctgctgtccggcacggcgctgttcgccctcgcgtcgctggccggcggcctggcgcaggcgccctggcagctgatcgcggcacgggcggtgcagggcatgggcgccgccctgatggccccggcggcgctcgccctgctcaccctcacccagcgcgagggccgggaacgcacccgcgccctcggcgtctacgccgcggtctcggccgtgggcggcgccgccggtgtgctcagtggcggtctgctcacccagttcgccgggtggcggtgggtgatgctggtcaacgtcccgatggccgcctgcgtcgtggtgctcgccctgatcggcgtcccgggcgggcagctcagctccgggccccgccgcacactggacgtgcccggcgcggtgctggtcaccggcggcgtcggtgcgctcgtgctcgggttgctgcgcaccgaccactacggctgggcctccgcgaccaccctggtcaccctgggcatcgccgtactgctgatcgtgctcttcctgctctgggaggcccgcgggatcaagagtgatccactcatccggctcggcctgctggccaagcgcaacgtcgccggcgccaacctgttcatcctcctgctctgcgcgggccagttcgcggcgttctacttcatctcgctctacctgcaggacgtcctgcatctggacgcggcccgcgccggcgcggcctttctgccgctcaccctcaccgtggtcgtggcgatcaacatctccacccggctggttccccggctcgggcccaaacctctgctggtgaccggcggcctgctggccgccgccgggttcgcgtggttcggcgccctcgacgccgacggcggcttcctcaccgacctgctgggcccctcgctgctcaccgggctgggcatgggcctgtccttcgtgccgctcaccggcgccgcggtcggtggcctcccgcggcacgaggccggcatggcctcggcggtgctcaacagctcccggcagatcggcggcgccctcggcctggccgccctggtgaccgcgcaggcgtcgcgcaccgatgcccggctcgccgccggtgacccgcctctggaggcgctgaccagcggattcgggatcggcctgagcctgtccggcgccctactgctggccgccgcactggtggccctgatcgtgctccccggtaagcgggccgccggcgtcccggccggcgagccagcggcccagcgcggcgcgtcgtcgtcttccccgtggccgacgaacgcgcccgctgggtcgcccccgctcgacgccgcctcgtccgtgaccgagccgaggtgacggtgccgatgaccccgccgaccggcctctggccactgctccggccgcaccgctaccaactgctgggcgccctgctcctgcagaccgtcagcgccgtcggcggcgtcgtgccctacctggccgtcgtcgagctcggccgcgagctgctcgccccgcacgcccccgaccggcaccgggtctggctcgtcgtggcggccggtgcggccggcctgctggtccggctggtcgccggggcactggcctcggccgtcgcgcacgccgccgacagcagcctccagctgtcgttgcgccggctgctggcgcgtcacctgaccgccgtgccgatgagctggttctcccgccagagcgcgggcggcctcaaccagatcgtccagaacgacgtcaacgacctgcacacgctggtcgcgcacacccccggcgaactgacctcggcggtggtggtccccggcctcgccctggtctacctggccgccgtcgactggcggatgacgctcgtggcgctcgtcccggtcctggtcgggctcgtcctgcgccgggcgctgtccaccgagcgacgcaagcgcgacgagcaggaggtggacgcggcgatggggcgcatcgcggtcgcagcggtcgagttcgtcgagggcatcgcggtggtgaagacattcggcgggggtggccgtgcccaccaccgcttcgtcggcgccgctgacgacttcgcccggctcttcctgcgctgggtgggcagcgcggcctggctcgcgtccctggccacgctggtgctgtcgccgatggtggtgctgctgaccgtgctgaccggcggcgccgcgatgatcggtgcgggtgccctggcaccggccgacctgctgccgttcctgctgctgtcgctggccctgaccgcgccggtcgccgcgctggcccacggcctcgacaacgtcaacgcggcccgccgggcggccggccggatcggggcggtactggccgagccgcccgccccgcgtcccgcggcgccgcggctgcccgacggccacctcatcgagctgcgtgacgtcgggttcgcctacgacgaggagcaccccgtgctgcaccacctcgacgtggtcatcccgcccggcagcaaggtggccctggtcggtccgtccggggccggcaagtccacgatcgcgcagctgctgctcggcttcctgaccccgaccaccggatcggtccggctcggcggcgtggatctgcgcgacatcgagccgtcggcgctctaccggcggatcgcgttcgtgccgcaggacgtgcgcctgctgcgcaccagcgtggccgacaacatcgcgctggcctcgtcgtcggccgggcgcgacgaggtggtggccgcggcccgcgcggcgggtgtcgacgaccatctgggcagcctgccccgcggctacgactcggtggtgggcgaggacgccgggctgtccggcggcgaggcgcagcgcgtctcggtcgcccgggccctgctgctcgacgcgccggtgctggtcctggacgaggcgaccgcgttcgccgacccggtgaccgaggcggcgacccgcgcggcgatcgaccgcgccgggcagggccgtacccgggtggtgatcgctcaccggctggcgacgatccgcgacgccgacctggtcctggtcctgtccgagggccgggtcgccgagcgcggcaccttcgacgaactgctcgccgccgacgggctgctcgccggcatgtggcgcgcccagcaggaggacgccaccggggtggcgaccgcgccgcagagaggaaccgtactgtgatcaccctgctgtcgcgcatcctcggacccgactatgcgcgcccgctgcaccgggcgatcgccctgatggcgatcgcgtcgatcgccgagggcctggcctacgcgctgctgatcccgctgctgcgggcattgctggccggcgacacatcgggcgccttgccgtggctgggcgcgttcgccggtgcgacggtggtcgccctgctgctgcggttccgcagcgacgtcgccggcttcgccaccggcgccgcgctgtcccggggactgcaccaccgcctcggcgaccacctggcccgtttgccgctcggctggttcacccgccgccggctcggcgaggtcggcatgctcaccagtcgcggggtgctgtccacgatggcggtgcccgcccaccggctgcagccgatgatcagcgccgtgctgaccccggcgaccgtcgcgctcgtgctcttcctcgtcgactggcggctggcgctggccgcggtgctgaccgcaccgctgatcctgctggcccaggtctggaccggccggaccaccgcgagcctcgatcgggagcgctcgatcagtgccgacgaggccgcgagccgggtcgtggagtatgtccgggcccagccggtgctgcggatgggcggcaccaccggccgtggcttcggattgctcgactccgcgctggtcgagcagcagcgcaccgggcgccgggccgcgatcagggcgatccccggggtgctggcgctgtcgctcacggtccaggccgggctgaccgcgctgctcgtgctcggcgcggacctggccctcggcgggcggatcgcgacggtcgacctgctggtcgcgctgatcctggccacccggtgcgtcgacccgctgctgtcgctgtccgacctcgccggccagatgcgcaactcgcgggaggagctggaacggatcgacggagtgctgtccactcccacgctgcacgagccggccgagccggtcgcggtgcgcgccggtgatctcgaactcgacgacgtcaccttccggcgtgatggccgcgaggtgctgcacggcgtctcggccgtcgtcccgaagggggcacgcgtggcgttcgtcggcccgtccggcgccggcaagagcaccattctgcagctcatcgcccggttccatgatccatattcgggaagcgtcagactcggtggaaacgatctcaaaacgctggcgtccgggcagctcgcgcagaacgtttccatcgtgtttcaagatgtgtatcttttcgacgggacgatcgcggataacgtgcggatgggccgacccgaagccaccagcgaagagctttccgcggcggcccggtcagcgcatttgacggaggtgatcgagcgtcttccgcagggctgggacacccgggtcggcgagggtggcgcggcgttgtccggtggcgagcgtcaacgcgtttcgatcgcgcgtgcgctgctgaaggacgcacccgtgctgctgctcgacgagcccaccgcagcgctcgacccggtcagtgaagtagcagttcaaagtgcgttggacggtctcatggtcggccgcacggtggtcatggtggcgcaccgtctgcgtaccgtgcggcatgtcgaccgcgtctatttcgttgaggaggggactatcgtcgagtcggggacccatgacgagctgctcgcgcagggaggccggtatgcgaatttttggaacatgacgcatatgaggcactgttaaaaagtgtcaagccatttataaatctctactactaggctagtctgggccaggttagagtcaccgctccgtaggggcgagacatctaaaggaggtcccggatgccgacgaattccgcgctttccgaaaacagcgataccatcgatcggagctcttattcacaaggtgctgccgacgatttacgagccttcgcctcgacactattgggcaggtcgctgacccccgacaccgacggcacgtcactgatcgagctcggactgcagtcgttgcacctgatgcggctcgtcgggcggctgcggcgggcgggccggacggtcggcttcgccgagctggccgccgatccgaccatcaccgcgtgggcccggctgctgggcgacgatccccccgcggaaccggcggcggaccgggagccggcgggcgacgagcccgccggcgacgtgccgttcacgctgacaccggtgcagcaggcgtactgggtgggtcgcggcgacgaccagccgctcggtggtgtcgggtgccacgcctatctcgagttcgagacgcgtgacctggacgtcgcgcggctgggcgaggccttccgcgccctgctcgcgcggcacccgatgctgcgcgcggtgttcgccggggacggcacccagacgatcgccgccgagtcgggctggtccggccccgaggtgcacgacctacgatcgagcacgccggccgaagccggggcggcgctgcgccggcttcgggagggcttgtcgtaccggcggttcgcggtgtcccgcggcgaggtcgtcgacctgcaggtcagccgcctgcccggcatggaccggctgcatttcgacgtcgacctgctggtctgcgacgtgcagagcatccgggtgctgctggccgacctggccgcgctctacgacgggcggcggccacccgagctgagcctcaccttcgccggctacctgcgccgccgtgccgcgggcgacgcgccggcccgggcctcggcccgcgactactggcacgcccggctggccgacctgccgggcgggccacgccttcccctcgcgatcgagcccggccggctggacaccacccggttcacccggcggatccggcgattgagcccaccggaatgggcggcgctgggacagcgcgccgcggcctgcggagtcaccccggccaccctgctgctgaccgcctacgccgaggtcctctcgcgctggagcggcgaccggcggttcctggtcaacatcccactcttcgaccgggatcgcgaggtccacccggacgtcccccacctgatcgccgacttcaccagcctcaccctgctcgacgtcgacctcgacgccgccggcgacttcgccgggcgcgcccgggcgatccagcgacgcctgcacgccgacctcgatcacagcgcctacagcggtgtcgaggttctgcgcgacatgctgcgcgccgacccggaatcgccgcggaccgcgccggtggtgttcgcctgcaacgtggacgcgccgctggtgccgcccgccttcgccgagcggttcggtgacttcacgttcatgctgtcccagaccccgcaggtctggctcgacaaccaggtctacctcgaccacgacggcgggctgacgatcgcctgggacgccgtcgaggacctcttcccggtcggcctgctcgaccacatgcaggacgcgtacgccggcttgctgcggtcgctggtcaccgccgagtgggccggggagccggcgatcggcctgccggagagcacccggtcgcgccgcgccgaggtcaacggagccgtccgcgcgcacagcgggctccggttgcacgacgggttcttcgcccgggcggcgcgagaccccgggcggccggcgctgctcgggggccacgacggctgcctgacctacggcgagctcgccgaccgggcgtgccggatcggcgccgccctgcgagcccggggtgtcggccgcggcgacaccgtgctggtgagtgcgcccaagggggcggatcagatcgcggcggtcctgggcgtgctcgccgctagctagctagaccgggcccgtccgctgctggccgcggtgctcgcgggcacggccgacccggcggccctgctggacgacccggcgctctcgccgaaggcgtggacctgcccggcgtcgccgactgcctgcgggcggccggtgaggtggtcggcgcggccgtcaccgcgcccggcgcggccggtctggtcgtggagtacgccgcgcacggcggtcgcacggccgacctgctgctggccggcggcacccgcggcgagggcacgacctacgtgacggtcagccgcttcccggaggtgccggcggccgcccgggcccggctcgccggtacggccacgatccgtggcgaggacggcacgacggtgccggacgacctgctgcaccgcgccgacatcgggctgatcaacgacacgttcgcgatcacctcaccggccgaggcactggccggtctgcggcccatgctgcgccccggcgcccgggtgctcgtcgtggccggcgccgaggacagcccgtccgcgctggtgctcggtccgctgctgcgcggcccgggtccgcggcgggccgccccgccggtcgcgtcgtggctggccgggttcgccacggccgggttcaccgcatgcgagatcgtgtgccccggcaacggcgtggccctgatcacgggctgcctcgacgagaccgccccggtcgtggccgccggccgggtcctggactgggtcgcgacgcgcctgcccggtcacatggtgccggcccggctggtggtggtgccggccctgccgctgagtgccaacggcaaggtggatcggggcgccgcgctgcggctggccgcggccaccccggtaccggcggccgagtccgcggcgccacggggacacctcgaggaggccgtcgccggactgtggcggcgctcgctcgggcgggacacggtgggccgccacgacaacttcttccaggccggcggcgacagcgtgctggccacccggatgctcgccgacatccgggcgacgttcggcacgaccctgccgatggtcgacgttctgcgggcgccgacggtggccggcatggcccgcctgatcatcgagcgctccggcgccggtgccaccgaagagacggaatccggcgtgctctagccgccgggtcaccttctgtccgtacatgggggattcatgacaacgaccgaagaaaccgctgcgcgcgcggcgcagggaccgctgcgccgatacgccgtccgcccgcacgcccgggcccgactcgtctgcctgccgcacgcgggcgggtcggccagccagttccgccggtggtcggtggacgcaccgtgggatgtggagatcctcgtggcccagtatccgggtcgggaggaccgctacggcgagccgcctcacgaggcgatgtccgccctggtcgccgaactgctcccggcagtcgtggccgaccgcggttcacccgcgcgccgaccgaccgtcctgttcgggcacagcatgggtgcctcggtggcgtacgagctcgcgtgccggctcacggctctgggtgacccgccggccgggctggtcgtctccggccagcccggacccgggcgcctgcgccgtaccagcctgcacacggccggtgacgacgagctgatcgcggatctgacccggctgcggggcaccggcgaggccgtgctgcgcgaccgggcgctgctcggtgcgctgctcccggcgatccgcagcgactaccgggtgatcgagacctatcggccaccggtccaccgcccgctcggcattccggtcacggcgctgcgcgccgtcgacgacccggaggccgacgcggacgaggtccaggcctggcgtgcggtcaccaccggcagtttccagacgtacgtgctgccgggcgatcacttcacgctgctggaccccggcggcccggcgctggcccgggtcatgtccgccgtgcgcgcggcggtcggtgccaccgtgtccccaaccttcgcgccctgatcgcaccgcactgaaccctctcctcctcggatcgaccctgcacagagatggacagccgcgtgctcgaaaactgtgttccctggcccgacgagatcaccgtcgcctatcggcaggcgggttactggaccgacgaggtcctcggtcgatggccggccggtgaccccggccgcgccggccgccccgccgtggtgaccgccgggcgcacgatgacctacgccgaactcgaccgggcggccgaccgccgcgcggccggcctgctcgaccgcggcatcggacgtgccgaccgggtcgtcgtccagctacccaacgacgtcgacctggtcgtgtgcatcctcgcgctgctgcggatcggcgcactgccggtcttcgcgctgcccgcacaccgcaccatggagatcgtcgacctggtcgaggcgtccggcgcccgggcgtatctgtgcgccgacgtgctcctcggtcacgacttccgggccatggcggccgaggttgtgcggcggacctcgacgctcaccgaggtcttcgtggccggtgcgcccggcgacttcaccgcgctcgccgacgtcgacgccgagccacggccgatcaccccgccggcccccggcgacgtggcgatgttcctgctctccggcggcaccacgggcaagcccaagctgatcccgcgcacccatgcggattacgcgtaccaactgcgcgccagcgccgaggtctgcggcgtgggcccggacagccgggtgctggcggcgttgcccgtcggacacaacttcccgctgggctgcccgggcgtgctcggggtgctgcgcgccggcggcgtggccgtgctggcgccgtcgccggcgccggacgactgcttcccgctgatcgcgtcggcgggcgtgaccctgaccgccctggtgccgccgatggtgccgctctggctggaagccgtcgagtggctgccggacgacctctcctcgctggaggtgctccaggtcggcggcgcgcgcctggatccggtgacggcgggccgggtcgtcggcggcctcggctgccgcctgcagcaggtcttcgggatggccgaggggctgctcaacttcacgcgcctcgacgacccgccggagctggtgctcaccacccagggccgcccgctctccccggccgacgagatcaggatcgtcgcgccggacggcacggaggtcgccccgggcgagcccggcgagctgctcacccgggggccgtacacactgcgcggctactaccgggcgcccgaggtcgaccgggtccgcttcaccgaggacgggttcttccggaccggcgacgtcgtccgggcccggcgcaccggtcacctggaggtggtcggacggatcaacgacgtcgtcaaccggggcggcgagaaggtgcccgcgcaggagctggaggagctgctgaccacgctgccggcggtggccggcgccgccgtcgtggccgtgcccgacccggacatgggcgagctgacctgcgcctgcatcgtcgcccgggagtcgcagggcgcaccggagctgcacgagatccggggcgccctgagcgagcgcggggtggccgccttcaagctgccggaccgcctcgtcgtgctggaccgcttgccgctcaccgccgtcggcaagatcgacaagaaggccctcgcggcgcgcgccgccgtgcagacgaccggaggaggagcccgatgaccaggcactatcgaaccgcggtgatcgagacgagcgacgagccgatcgcctgcgccctcgcagtggccgacctgttcgacgactacgtcgtctacgaggcgccggacggctggtacgtcgccggcggctgggccgccgaggtcgtggtcgggccgcggacggtgcggtgcgtccacgacggacaggtcaccgagacgccgtgggacgacgacccgctcgtgccggtgcgccgcttcctcgacgggctgcccctggccggctggcgggcgtacggctggtgcgccttcgagctgggcgcggcgatcgccggcctggagcccccggaggacgtgctcgcccacttcctgatccccaccgtcgagacgcggctgcgggggacgcaggccaccgtgcgcggcctcaccgccgaggacctcgccctggtggagcgccggctcaccacgccggtgcgccgggccggccgggccgccggacgcgcccgggtcgacctgggcgccggcaccgccgagtaccaggacgccgtggccaccctggtcggcgacatccgggccggaaagctggagaaggccgtgctgtcccgggtgatcggcgtgcccgagaagatcgacttcccggcgagcttcgaggtcgggcgccgccgcaacacgccggcccgctcgttcctgctcgacatgcgcggtctgcaggtcttcggcttcagtccggagatcgtgctgagcgtcgatgccgacggcacggtggtgagccagccgctggccggcacccgggcgctgtccggcgacgccgagaccgacgagcggctgcgccatcaactgcgcaccgaccccaaggagatccacgagcacgcgatctcggtccgggtcgccgtcgaggagctgcacgagccgtgccggccggacaccatcgcggtgtcggagttcatggcggtgaaggagcgcggctcggtccagcacctgggctcgcaggtgaccggccggctggccgagggccgggacgcttggtcggctctggccgccgtgttccccgcggtcaccgcctcgggggtgcccaagcaggccgcctacgaggcgatcagtcggctcgagggccagcggcgggggccgtacgcgggagcggtggtgaccgtcggcgcggacgggaccatggacgccgctctggtgctgcgcagcgcgtactcacgggacggggtgacctggctgcgggccggcgccggcgtcgtcgggcagtcccggccggaacgtgaactggaggagacccgcgagaaactcggctgcatcgccggttatctcgtggtcagcgaaggctgaggcggctcggccgcatttcgtcgtcaagaggtgatcgcaagtgtccacggggacgaacatccacatcgagttgctggggccggtccgggcctggcgcgacggccaggccgtgcacctgggcccgccgaaacagcgtgccgtgctggggctgctggccagccgggcgggcgaggtcgtcggcgtcgaacagatcgccgacgcggtctggggatccgacatcccgcagaccgcggccaacggcgtgcacacctacgtggcgggtctgcgacgggtgctcgagcccagccgcagccggcggcagaccggcgaggtgctggtctcggcggtcggcggctactcgttgcagaccgacgcgcgggccgtcgacaccgcgctcttcacccagatgatcggcgaggcccgccagctgcgcggcggcggcgacgtgaccggggcggtggagacgttcgaggccgctctcaagctgtggcgcggcgaggcgttcggcggcgtgcccggcccgttcgccgcgctggagcgcagccggttgcaggacctgcgcctgaccgcggccgaggaccacgccgcgtgcctgctcgacgcgggccgccacaccgaggcggtcggctggctgaccgaggcgatcggcgaggacccgctgcgcgaacggctgcggggctccctgatgatcagcctctatcggtccggccggcaggcgcatgcgctgcgggtcttccgcgagacctgtgagctgctgcgcgacgagctcggcatcgaccccagcccggagctgcgtgagctgcaccgccagatcctggtcagcgacccggccctgggcgccgccgccgcgccgccgagcaccccggtcgccgtggttccaccgctcccggcggcgccaccggtgcagttgccggccgtgccgtccgggttcgccgggcgcgacgaggaactggccctgctcagccgcgagctgctgcgcgcggacggggacgagggagcggtccggctcgccgtggtcgacgggccacccggggtgggcaagaccgccttcgcgctggagctggccaagcgcatcggcgggtccttcccggacggtcagctcttcgtcgacctgcgcggcaccgacccggccagcgcgcccgccggcccggccgagtgcctgctgttcctgctgcgcagtctcggcgtgcaggacgcgcgcatccccgatgacctggtcgggcggatcgcgcactaccagagcctggtgcacgcacggcgtctgctgatcgtgctggacgacgcccgcagcgccgaccaggtccggcccctgcttccgcgcggttcgtcgtgcgttctggtgacgagccgggtccggctcagcggcctggtcgcccgcgacggggcgcaccgggtgcccatccggccgctcgatccggaggtgtcggccgaactgctggcgcacctggccgggcgggagcggatgcgcccggacagcccgatcacccggcgcctggcgcacctgtgcgggcatcttccgctcgcgctgcggctggccgccaacgcgttcgccaccgatcccggccatcccccggccgagctgctcgaacgttacgtcgccgagcccagccggctggaccggctggccgtcgccgacgatgcctcgaccagcctgcgggcggcgctggacgtctccttccaggcactgccggacgacgccgcccggatgctgcggagtctgggcgccgcccggcgcgagacgatcaccgccaccttcgccagcgcggtcaccggcgctccccggcagcaggtgcagcagcagctgaccgtgctggccgacaaccggctgatcgaggaggccggcccgggcgagtaccggctcaacaacctggtggccctctacgcccgggagtgtgcaggcgatgccggccgggagcgggcgtcctgagcggacggtgcgggaggtacagagcgaaaccataggccctacagacgtcgatgccaggctggtcaggccggaacgggacgtgcgcgagaacgggagcggcatacatgcgtgtcttgctgatgagtgggctcggccccgccaacctcaactcgggatacctctccgggtcgctgctggagggggaccgcggcccacgggcgacgcaggtgctgcagcgggccgggcaccccgacctggacgtgaaccagctggccttcgagaagggtgggcgccggtacgcactgctgcgcccccgccccgactcggtgccgcacctgacctcggtcaccctcacctcgatcctggccgccagcggccacgacttcgtgcgggtgccgctggaggaggtgtggacgtcgcaggcccggccaccttccggtgacatcgacgtggtgctgctctcctcgaccttcatctggaacgaagggatcgtggccaccgcgctgaagtggatcgccacgcacgtgcccgacaccccggtggtgatgggcggccagtacacgaacctgaagttcatgccggtgatgcgcgatcaccccgaggtgatcgcggtggtccgcggcgacgccgaggagagcctgccccgggtgctcgacgccctgcaggccgcagccacgctcgacggcatccccaacgtggtctggcgcgacgggccccggatccagatcaatcccctcgcgtacgtcgacatggagctctttccgtccccgacggtgagcggctcggcgccgatcgtcccctacgagtcgatgcgcggttgtccgttcgactgcaagttctgctcgttcccggccgcgtcgccgaagtggcggtacaagtcggccgagaagatcgtgcacgactggacggcgtacgccgcgcacaacgacgccaagatgatctcggcgatggactcgaccttcacggtcccgccgacacgcctgcgtcgcctgctggagttgctgcccggcgccgagacgccgccgtgggagggcttcagccgggccaacaccatcaactcgcccgagctggtggagaacctggcccggtcgcggtgccggcaactgcacatcggcttcgagtcgatgaacgacgagacgctcaaacggatgagcaagcgggtgagcgtacggcagaaccggcgggccggtgagttgctgagccgcagcgacgtcggctattacgtcttcttcatcgtcggctacccgggggagacccccgaggcgttcgccgacaccagcgacttcctggtcgacgagtacgtcggtcacttcgcgctcagcaggttctcgatcaccgacgagacgatgccgctctggcaggaccgcgacgagctgcgcatcgtctccgacgacccgaccgatccgaccgccgcgtggtcccacgtcggcatggacagcgccgaggcgtcccggttgcagaaggagaccctcgaccgggtgcgccacggcagcgagacggccgtgctgcacctgtggcagcactccttccagcactggctcatgccgcaccgggaccgtttgaccaacatccgggtcgagaagtgcgtggaacggatggcgatggcaccggtcgactatcccgacgtcgcccaggcggcgaaggtcgtcaacgacgaactcggcaaactgcgcgacctcggcatcgaacggaccgacgattcccggacgctgtgccgggacgcgatatagcggaaaagaaccacgcgcgggcgccggatgccaccggcgcccgctcttttttgccgcatcgaggcaccccagaaaccgtccagaaggcctccagagagacgacagcggaagcgaccaagatgaagacgtacgtggatcgaaggcggaatccgcgcccggtctgttcgccatcaggaaggtcggtctcgatgtcctcccagctattcggagtccccgacgaattcgacgtcatcgtcatcggcggtgggccggccggtgcgaccacggccggtctgctcgcccagcgggggcacagcgtcctggtcctcgatcgcgagcggttcccgcgctaccacgtcggggagtcgctgatccccgccttcatgcgcccgatgaaggagctcgggctgaccgagcggatggacgcccgcggcttcgagcgcaagtacggcggcaccctcatctggggcaacgagcaggtgccgtggcagttctcgttcatcgagggcgggtacgagtacgcctaccacacccgtcgcgccgacctggacgcgctgatcctcgaccgggcccgtgagctgggcgcctgcgtcgtcgaggacgccacggtccgcgagacgatcgatgtcgacggccgggtcaccggcgtccgctacgcgctgcgtggcggcgacggcctcgtcgaggcccgggcccggctggtcgtcgacgcctccgggcaggcccgggtgatcggccgccggcagaccggcgtgaagtggcacgacgaactgcgcaacgtcgccgtctggacctacttcgacaactgcgagcggctgcccggcgacgagtacaccaacatcctcatcgagggcctcgacgagggatggttctgggggatcccgatcgacaagggcacgatcagcgtcggctacgtgacgcgcgcgtccatggccggcgagggcgaccagaagctcgagcagatcttccgcgagcaggtcgagcgcaccaccaagctgaagaagatgctcgcgcccgggcggcgctcggccggattccggacggcccgggactggtcctatcacagcgaccgtttctacggcgacggatgggttctcgtcggtgacgcggcagccttcgtcgacccgctgttctcgaccggtgtcgccctggccacgctggccggcagcaccctcgcgaaaatcgtcgaccagatcatcgagcacccggagatcgaggagaaggcactggaccggtacgccaccgcgtactcgaatttcttcgacgagatccggacattcgtcgagcggttctacgaccgtacgaaatataaggagttttatcacagcctggcgcaggaaatggttgatccggagcagaagaacaagccgtcgcaggacttcgtcacgctgatctccggaatgagcggcaaacacgcgatgttccacatcgacctcagcgacctgatcgccgcggacgacgggcgatgagcagcacccaggtgcagctgctcttcgtcgacctggccctcatcctgctcctcgcccaggggttggggcggctcgccgtcctggtgcgccagccgccggtgatcggcgagatcgtcgcgggcatcctgctcggccccaccctgctgcacggccggctgtccgccacgctcttccccggcggcgtccggccactgctgggcgcgatggctgccctgggtgtgctgctgttcatgttcggcgtcggggtggaggtcgagcaccacgtcctgcgcggccggggacgggccaccgcgctgtgcgccctgggctcgatgctcgtgccgttcctgctcggcgccggactcgccgggacactgctgtccggccaccgcacggcgagcccgaccggatacgtgctcttcgtcggtttggccgtttcggtgaccgccttcccggtgctggcccgcatcctcagcgaccgcgggctcgcgacgaccgcggtcggcggggtggcactggccgtggccgcgctcgtcgacgtgatcgcctgggccgcgctggccggcgtgcaggcgttcaccggcggtcccggacagcactggcgggtggcgctgatcctgcccttcgccgcgttcctggcgttcgtggtgcgcccgctggcccgccgctggctgctgtccgcccgggccggcgccgacccgggggagccgtcgccgctgcgcttcggcgtggtggtgatcggggcgctgctcagcggcgcggcgaccgaggtgatgggcctgcactatctcttcggcgccttcatgttcgggctggtcatgccccgtgagggggcccgtgggctgcgcgacggtctgttgcgtcaggtcgggcgggtcaccgcgctgctgctgccggtctacttcgtcgtggccggcctgcaggtcgacctgagccacctgggcgtcaccgcgttcctcgaactgggcgcgatcctggtcgtggcgatcgccggcaagttcgccggcgcctacctcggcgcccgcacgcagggcctggccgcccggccgtcggcggcgctggcggtcctgatgaacacccgaggcctcaccgagctcatcatcctgggcgtcgggctccagctcggcctgctcgacggcggcctctactcgctgatggtggtcatggcattggtcaccaccgcgatgaccggaccactgctggccctggtctaccgcaagcccgtcgagatcaccgtcccggccccggccgcgtcccccgcgctgtccggcgcggccggccgcgccggctgaccgcccgcccgtccccgaccggaggaacgtaccgatgaatcagcacatcgccggcaagcgagacacctacgacgtcgccatcctgggcgccggcatggccggcggcatgctcgccgcagtgctcgcccgccacggcgtacgggtcctgttgctcgacgccggcgtccacccccgcttcgccgtgggggagtcgaccatcccgtacacctccggcatgacccggctgatcgcgcagcgctacgacgtccccgagctcaaggcactgtccagcttcaagggcatccgcaccagggtctcgcgctcctgcggccagaagcagaacttcggcttcgtctaccaccgggagggacaggcacaggatccgggacagatcaaccagctggtggtcccgtcggcgatccggaccgagacgcacctgttccggcaggacgtcgacgcctacctgttccacctggcggtggccaagggggccgtcccgcgactgggcaccaggatcgagaacatcgagatcgacccggacagcggggcggtgctgcgcagcacgaccggcgaggagttccgggccgcttacgtcgtcgacggcagcggcttccggtccccgctggccgacgcgttcagcctgcgggagacgccgacccgggcgcgcacccacagccggacgatcttcacccacatggtcggggtcacgccgttcgacgacgcgccggcggcccggcaccacaagaacccgaacccgtggcaccacggcaccctgcaccacgtcttcgacggcgggtggctctgggtgatcccgttcgacaaccaccccagctcgctcaacccgctctgcagcgtcggtttgacgctcgacccgcggatccatccccaggacggccggtccgggcagcaggagttcgacgacttcctggcccggttcccgcagatcgcccaccagttccgcggagcgtccgccgcgcggccctgggtgagcaccggacgactgcagtactcggccaagcaggtggtcggcgaccggttctgcctgacctcgcacgccgccggcttcatcgacgccctctactcccgcggcctgaccaacacgatggaactggtcaacgccctggcctggcgcctgatcgccgccgcccgcgacggcgactggtcgaccgagcgcttcgcctacctggaggcgctgcagcaggggctgttcgacttccacgacgacctggtgtacgcctcgttcgtcgggttcggcgactacgagttgtggaacgccgtcaaccgcacctggatgctcggcacgatgctcggcaacgtcatgctcgaggacgcgtactaccgcttcctgcgcaccggcgacgacgcggtcttcctcgacctggagaacagcgcccgccccggctcgccgctgccggtcagcgacggcttcaaccggatgggcgtgctggcccgcgagctgtgcgagtccgtcgaggccggcaccaccaagccgggtgatgccgccgccgcgatcctcggccacatcggcggcgccgacttcatcgcgccctccttcgccttcggcgagcgcgacacccgctgcttcaacatgacgcccgccaagatggcgcgcaacgcggtgtggtgccgccgggaggccccgcccgagatcggccctcgaatgatcaacgccagcaagggtctcgtgcggatgcggctgcgcggcggcgagtgatctcccgccccagccgaccagaggagaggaggagcggcatggagacacatcaccacatggacgagaccccgcttgccgtggtgggcatggccggccggtttcccggcgccgccgacatcgacggcctgtggaagctgctgatcgacggcgccgacgccatcggcccggtcccggcccggcgctgggacgcgggcgccgtgctcgacccggaacgggcgatccagggcgtcggcggcttcatcgacggcgtggaggagttcgacgccgggttcttcggtgtctctccgcgcgaggcggccgcgatcgacccgcagcagcgcctgctgctggagacggcctggcgcaccctcgaggacgccggcatcccggcggccggtctcgccggatcccgaaccggtgtctacgtcggcgcctcctggcacgactacgagctggtccgtgggcgcagcgccgcaccggccacgccgcacagcctggtcggcaacgcgctggacgtgatcgccgcccgggtgtcctacttcctcaaactgcgcggcccgagcatgaccgtcgagaccggctgctcatcgtcgctggtggcgctgcacctggccgggcaggccctgcgctcgggggagatcggcgcggcgctggtcgccggggtcaacctcatcctcgacccgcacgtcacggtcggcctgacccacttcggggcgctctcgccggacgggcgctgcgccacgttctccgacgaggccaacggtttcgtccggggcgagggggtcgccgcgctctgtctcaagactctcgaccgggcgctggccgacggcgaccggatccacggggtcatcgcgcggaccgtggtgaacaacgacggcggcggggagagtctggtcactcccagcccggacgggcaggaggacctcatccgctcggcgtacggcccgccgggcgagcccaccggtccggcgcccttctacatcgaggcacacggcaccggcaccgaccggggcgacccgatcgaggtcaccacgctcggccggctgctcggccgtcccggtgacgaacccctgcacgtcggatcgatcaagacgaacatcggccacctcgaggcctgcgccggcctggccgggctgatcaagctgctgctcgtgctgcggcaccgggtcgtgccgccgagcctcaactcggcgcgcctcaacccggccatcccgttcaccgacctgggcgtgcgggtggtgcgtgaaccggtgccggtgccggccggccccgtccggctgggcgtgagctcgttcggctggggcggaaccaatgcccacgtggtggtgcaggacccaccggtgggcgggccggaggccgggcgggacggggcttcgaccggacttcccccggtgaccatgctgtccgccaaggactggccgtcgctgacccgccgggccgctgacctggccgccgccgtacccgccgccgccgaccgggtgcccgggctggcgggcaccctggcctggcgacgcgaccacttcggggtgcgggccgcggtggtcggatctcggccgcaggagctgcgccggctgctcgacgcgctggccggccgggccgaggacgcccaggacgaccccggtctggtcaccggccgcgcggtcgagaccggccgggtcgcgttcgtctaccccggccagggcgcgcagtgggcggggatgggccgcgagctgtaccgcgacagcccggtgttccgggacgtgatcgaccggtgcgccgtggccctgcgcccgcacctcgacgaggacctgctggacgtgttcgccgccggcggcgacgaccgctggatggaccgcctcgaccggctgcagcccgtcctctgggcgaccgcactcggcctgaccgcgctgtggcgtgcctgcggcgtggaacccgacgtggtgatcggccacagccagggcgaggtggtggcggccaccgtcaccggcgcgctcagcctcgacgacgccgccctggtggtggcccggcgcagccggatcgccgcccgcaccagcggtcgcggccggatgctcatggtcgacctcgacgtcgactcggcgtacgccgcgctggagggtttcgaggacaccgtcgcgctggccgcgcacaacggaccgacctcgtgcgtgctctccggcgacgccgactcggtgctgatcctcaaggaactgctggaggccgagggcacgtactgccgcctggtcaacgtcgactacgcctcgcacagcccgcagatggacgcgctgcgccccgatctgctcgacgcgctgagcgccgtccggccccggccgggccgtcccgcgatgatgtccacggtgcgccgggcgctggtgtccggcaccgagttggacgccgcctactgggtggacaacctgcgccgtccggtgatgttcgcggacgcgatcggcgacctgctcgacgacggcgtcacgcacatcgtcgagatcagcccgcacccgatcctggtcaccccgatcaagcgggtctcggcacggcgcgcgcacgccccggccgtcctggcgaccctgcggcgcggtcagggcactgtcggagacttcgcgacggccgccgcggccgcctacgtcgccggcctggagccgttcggcggcctgccgcgcgagggtgtggccgccgcccccggatatccgctgcggccggagccgtactggccggtggaggcccccggcgcctggtccggcacccagggcttcgccgcccggctgcgcccggcaccggacgacccgggcagctggaccgccaccttcacgctctcctgcgccggggtgccgtggctggccgagcaccaggtgcacggtgtgccggtcctgccgggcgcggccgtgctgacggccctgctgtcctgcgcacggcagcggtggcgggcggccccggggctgatcaccgggctgcggctcaccggcgcggtggctctcggcgaggccccggtcgggctggccgcccactggcgcgacaccgcccggggcgccaccgtccggctgctcgcgctgcccgaggcggccacgacgtgggaggagaaggcgaccgctcgtgtcgtccgcgctcagcagccccgcctggcgccggccttccccgacgatctcgccgcccggctcacccatgacgccgacgacttctaccgcctctggcacgggcgcggcctgcagtacgggccggctctgcgcggcatccggcgcctggccgccggcgacgggcgggcgctgggcgagatcgtgctcgccgagcggctgcgcgcggccccgtcccacggcgccccgcatccggccctgatcgacgccgcactgcaggtggcactggccgcctgtgagccggccggcgacaccgccgtggtgccggtcgcgctgggcacggtcgagattctgcgggcgcccgaggacaccacggtcacgctctggtcgtacgccgagcgccgcggtcccgccgatgccgacgtgatcgtcttcgacgaggcccggcacccgctgatggtgctgcgcggcctgcggttcgagcccctggccgagcacggcgcgagcgcggacgacgcgttgcgctaccacctcgcctggaccgagccggtcgagccggaccccgtgcccgtccccggccgatgggcgctctgcaccccgccggccgggtccggtgacgcgctggccgaggcgatggcggagctgggcgccgaagtcgtgcctcaccggtcgggcgacaccgtgcccgacggcctggatggcgtcgtcttcctcgcgccgtccgcgtccgccgactgcgaaacccaggaacgtgggctcagcgcgctggccggcctcgccaccgccggcaccgccgccgggaccacgccgcgcctcgcggtgatcacggccggcgcacaggccgtgacggccgacgacgtcgtgaacccctgcgccgcgctctactggggcttcacccgggtgctgcgccgcgagcacggcgagctcggcgcgcgcctgatcgacgtcgacgcggccggtccggagtgggccgcccgggccgccgccgaggtgctcggagcctccgccgaggaccaggtcgccctccgcgggcgacggcgtctcgtggcccggctccgccccgggccgggtgcgccgcccgtgctgcccccgccggtcaccccgccgcagccgttccgcggcgcggtgaccgacgcggggcagctgatctgggtgccggaccgcgtgcgtcgctgcggccccggcgaagtgagtgtcgcggtgaccgccgcggccgtcgacgagcatgacgaggcccggctgcgcggtgccgccaccggtgacggggacaccagcctcggcacctcctgtgccggcatggtcaccgcggtcggaccggacatcaccggcatcgcggtgggcgaccgggtcgtcgcctgcactccgggcgcgctggccgccgaggtcaccgtccgggccgatcacacccggccggcgcctccggcgctgagcgacgccgaggcggccgccctgccgctggtactcaccaccgcctggcacgccctggtccgcctgggtggggtggagaccggcgacaccgtgctgatccacgcgggcaccgacggcaccgccctggccggcgtcgcgctggcccgcctgcggggcgcccgggtgctggccaccgcgggtgacacgaccgcgggggaactggccgagtcggccggcgccgcgctcgtggtcgacacccgcgacccggactggacacggacggtgctgtccgccaccggtggccgcggcgtcgacatggtgctgcacccgcaggccaacccggacgtggagatcgaggacagcctgaccgtgctcggcgtcgagggccgcgtcgtggtgctgggcgccgacccggtccgggtgcacccaccggacctgctgcgtcccggcgtggggctcagcgtctgcgacgtccggcaactgctcggccggcacccgcaccgcttcgcccgcacgctcgaactggtgtgggatctggtggcggccggccgggtgccggccctgccggtgcggaccatgacgtacggccaagcggcccgggcggcgccggaccggaaccgccgcggcgcgcagcggctggcgctgaccgacccggccaccgccaccgaggtgaccccggtgccccgccccgacggtcagttccgggccgacggcgcctacctgatcaccggtgggctcggcgcgctcggcctgtcgctggccgagcatctcgccgaccggggagcgggcgccttggtgctgctcggccgctccggcccggaccccaccgcggagctgcgggtcaaggcgatgcgcgcccagaacgtccaggtcgaggtcgtcgccggcgacgtcgccgacagggacgcgctcggcgcggcgctggccggcgtccgggaccggatccccccgctgcgcggcgtcgtgcacgcggccggcgtcctcgccgacgccaccgtggccagcctcaccgaccggcacctgcacaccgccgtcggcgtgaaactcggcggagcccggcacctcgacgcgctcacccgcaacgacccgctcgacttcttcgtcctcttcagctccgtggccgggctgctgggcaacccgggccaggccgcctacagcgcggccaacgccgccctcgacgcgttcgccgaggcccggcgccgggccggccgggcgaccacgagcatccagtgggggccgttcgccggcatcgggctggccgcggccgagcggggacgcggcgaccggttggccagccgggggatgggcggcatcgagccggaggcggcgtgggcgctgctgaccgcggcgctcgacgaggaccggccggtcaccgcctatgtcgacctggacctgcggcgctggttcgacgcgaaccccgagacggcggccctgcccagctggcgcaccctgctcgagctctcgcgccgggacggcggcccggcggtcgccgacggcgacttcctggcccgcctgcacgcggcggagggtgcggaccggctgcgggtggccgagatcaaggtgcgcgagctgaccggccgggtgctgcggctggacccggcggccatcgaggccgacgccggtttcaagtccctcggcctggactccctgctcagcctggaactgcgcaaccgactggagtcgatcttcggcctgcggctgtcaccgaccgtgctctgggcccacagctcggcccgcgccctggccggcgcactctgcgagcgcctgaccccccacggaggaccgacgtgacatccgagaccgaatccgccgaccggggcccgctgcgccgggccatggccacgatccgtacgttgcagagccgcctcgccgcccaggacgagaaccggcccgtggcgatcgtcggcgccggcctgcggctgccgggcgggatcacgagcctggccggctactgggacgcgctcgccgcgggccgcgacctggtcgctccgatgccggcggcccggcaggcccggttcgccgccgactgggcgacgctgccgcggcgcggcgccttcctcgacgacgtcctcggcttcgacgccgccttcttcggcctgagcccgcgggaggcccggcacctcgacccgcagcaccggctgttgatggaggtcgcctgggaggcgctggaggacgcggcgctgcccgccgaccgactcggcagccgctcggccggtctcttcctgggcatcatgtggcaggactaccgcgactggcaggccggcgagccggacgccttctggacgaccggcaacgggcacaacttcgcggccgggcggatcgcctacaccctgggtctgaccgggcccaccctggccgtcgacacggcctgctcctcctcgctggtcgccctgcacctggccgtgcaggcactgcgccggggcgagtgcgaggtggccctggccggtggggtgaacctcatcctgtcgccgcggtcgacgcggctggtcgtcgagacgcgctcgctggcgccggacggccgctgcaagagcttcgacgccgccgcgaacggcttcacccgcggtgagggctgcggcgtggtggtcctcaagtcgctcgacgcggcgcgccgtgacggcgaccgcatccatgcggtgatccacggatcggcggtcaaccaggacggccggtcgggtggcttcaccgtgcccaacgtcctgtcgcaggtgcggctgatcgaggacgccctcgccgacgcgcggctcaccgcggccgacatcgggttcgtcgagacgcacggcaccggcaccgcgctcggcgacccgatcgaggtggaggcgctggccgccgcgctcgggcgccgcaacggcggcgcgccgctgccggtcggggcgggcaagacgaacctgggacacctggagtcggcggccggcgtcgccgggctgctcaaggcggtgctcagcctccggcatcggcaggtcccgccggtcgtgcacttccgcaccctcaacccacggatcgacctcgacggcaccggtatcgtcgtgccggcgcggctcaccgagtgggcacccggggcgggccgctacgcaggggtcagctcgttcggcatgagcggcaccaacgcgcacgtcgtgctgggcgccgcggagccgtccggcccgccaccggacgacgccccggccccggccgggttcgagatctcggcccggaccgagccggcgctgcgcgagctcgccgcccggtacgccgcccggctggccacactgcccgccgccgacttcccggccctcgcgtccaccaccgcgaccggtcgcagccggctggccgagcgtgcctgctagctagctagccaccgaccacggcctgctgcacggcctggcgccgaccctgggcctggagtacccggacggttggggtggggtggtggacctgccggccgatccgcggcccaccgacgtccgcccgatgctcgacctgatcaccgccgatgacccgccggagctgaccgccgtccgcgccggcgtggtgctcgccgcgcggctgaccccggcacggcccggcgcggggctgccggagttgcatccggacgccacctacctggtcaccggcggcctcggcgcggtgggccgccacctgaccgcggagctggtcgcccgcggtgcccgccatctgctgatcatcggccggcggccccgcgcggcgctgcccgacccggccaccggtttcctcgccgaactggccgctcagggagtcgacgtccactatcgcggcgacggctgcgacaccgccgtggacctggccgcggcctgcgctcccctcgccgggctgccgcccgtgcggggcatcctgcacctggccggcaccgtgaccagcgccgcccccgcagatctggacccggccgcgttcgccgcggccgccgcggccaaggccggcggtgcctggctgctgcaccgggccgccgtcgactggccgctcgacttcttcgtgctggtttcctcggtctcggcgctctggggctccaaggggcacgccgcctacgccgccgcgaacggcgcgctcgacctgctcgccgcgtaccggcgcgggcagggactcccggcgaccagcgtggcgtacgggccgtgggccctcgacggggagggcatggcggaccgggcgacccgggagcgcgccgagcgcaccggcatcggcgcgatgggcgcggccgaagcccgttcggccctggccgtggcggtgcccggcgccgcgggacacgtgatcgcctgtcgcgccgacctggttcgcctcggccgcgtcctgccccggttgcgcgccggcctgctggccggccacgccgaaccggtcaccgggacggccgccggaccggtcagcgggacgaccgccggaccggtcgcgccgccggcgcccgtcgatgccgccacggtgcgcgacacggtcgcccacctgctcgccgtgcaactcggctacgacggtgccgccgacatccgacccgacatgggcttcgccgacctcggcctcgactcgatcaacgcggtcgacctggccgagcggctcaccgcccggctgggccgggccgtgccggtcaccgcgctcttcgaccaccccagcgtggccgagctgaccgcgtacctgaccggcgctagctagctagccggccgtcgcccggcggcgagccgatcgcgatcgtcggcatggcctgccgcttcccgcaggcggactcggccggggagctctgggaactgctggacgccgggatcgacgcggtcggcccggcgcccgcggaccgctggggcagcgggatcctgcgcggcgggcgggtcaccaccgaccagggcggctacctgcgtggcatcgacctgttcgacgccggcttcttcgacgtgccggcccgtgaggcgcgcagcatggacccgcagcagcggctgctgatggagacggcgtggcacgcgctggaggacgccggcatcgccccgtcggcgctgcgcggaaccgcgaccggggtgttcgtcgggatcagctacgccgactacgcccggctgttggcccggggcggcgccgacgacgtcgacgcctactacgggaccgggaccgcgctcaacgcgacggccgggcggctcgcgtacgccctgggactacacggaccggcgctggccgtggacacggcctgctcctcctcactggtggccgcgcacctggcggtgcgcgccctgcgcgccggggaagccgacgcggccctggtcggcggggtcaacatcctgctcgacccgatgtcgtcggtggcggtgagccaggcccacatgctggcgccggacggccggtgccggaccttcgacgccgacgccgacggcttcgtccgcgccgaggggtgcggtgtgctggtactcaaacgcctcgccgacgcccgccgcgacggtgacgacgtgctcgcggtgatccgcggcagcgcggtcaactccgacggtgcctcgtccggcctcaccgtgcccaacggcagcgcccaggagcggctgctcaccgcggcgctggccgacgccgggctgcccggccacgccgtgtcctacctggaggcgcacggcaccggcacccggctcggcgaccccatcgaggtggccgcggcctggcgtgcgctcggtcccggccgggacaccggcgagccgctgctggtcgggtcggtcaagagcaacatcgggcactgcgagtcggcggccgggctcgccgggatcgtcaaggtgctgctcgcgctgcgccacggccggatcccggcgaacctgcacttccgtacgcccaatccgcacgtggactgggccgggacgaatgtccgggtggtggcggccggaaccccgtggccgcgtggcccggttccccgggtggccggtgtctccggcttcggcttcaccgggacgaacgcccacctggtgctggccgaccccgatcagccctcggtgacaccaccgacccgacccggctcggcacacctggtgaccgtgtcggcgcccgacccggacggcctggcccgggtgaccgcggcctggcacgaccggctcaccggcgcggccgacggcgacctcgccgcgctggccgcggtgagcgggcgcggccgcacccacttccggtaccggcggtccgcggtcgggcgtaccggcgccgatctggccagggagctgaccgccgccggaccggtgtacggcgcggcgcaaccgccgcgggtcgcgttcctcttcaccggccagggcagccagtacttcggcatgggacgcgacctgtacgagacggagccggctttccgcgaggtgttcgaccggtgcgacgacctgatgcggccgcggctgggcacgagcctgaccgagctggtcttcaccggggaggacgcggccgcgctgcaccagacgagggtcacccaaccggcgctggtcgccctggcgctgtctctggtggcgacctggcgcagttggggcgtggagccggcgaccgtcctcgggcacagcgtcggggagatcgcggcggcggtctgcgccggcatcctcgacctgcctgccgcctgcgagttcgtggtccggcgggcggagctgatgcagagcaccgggcccgggcggatgctgtcggtgccggcgccggagaagctggtcgaggagtggatccgggacaccggcctggatctggccgcggtcaacgggccggaggcgacggtggtcgccgggccggccgacgcgatcgaggccctggccgcgcgcctgagcgccgagaacgtacggcaccggccactggccacctcgcacgccttccactcccggctgatggatccgatcctggaccggctgcgcggcgagctggccgggctgcgcacggcccccgagacgattccgctggtggccaacctgaccgggcagaccgggaccaccctcgacgccgagtactggtgcgagcaggtccgccggccggtgcgcttccacgacggcctggtacgcctgggcgaaatcggcgccgacgtgctgctggagatcggccccgaccgtacgctcaccaacctcgccggtgccgccgggctggtaccggccggtggggccgtgtcctcgctgcgccgggggataccggcacgcacggccatgctgaccgccgcggccgcgctgtaccgggccgggcagcggctggacttcgaccgcgtgcacccgacccgcccgggacgggtggacaccccgcgctatccgttcgcccgcacgtcgtactgggtgcggccgcaaccggtcgccgccacgacaccggacgcctcggccggcccggcgtggggaaccgaactgcgctcgccggcgctgccggggcgcgtgttcgcgagccatcgcagtaccacctacccggcccatctgaccgaccaccggctcttcggcacggtctccgtaccgggcgcatcccagctggccacggtcctgtccgcgctctccggtggccgcgacaccgtccggctgcaggacgtgcacttcccccgggcgctggtgctgcacgagggcgagcgctacgagcagcaggtgatcgagtcagcggggccggacggtcgccgggtcaccgtgcagagtctggtccacgaggagaccggccgctggcaggagcatctggtcgcgcggctgccggccgagccgcccgcgaccggcgccgacgacggcccccgggccgaccacctgcgtcaccgggctgaccgggagctgaccggtgaacggttctaccggcacctgcacctgctcggctaccacctcggcccgtcgttccgctggatcgaccacatctggatcgccggtgaccaggcgctggtccgcctgacccgcccggtcgagacacgggaggatccgggtgggtacgcggtgcacccgggactgctcgacagctgcctgcagagtgctgtctgcttcgccgtcgacggcgagccggacggcgagccggacagcgagccggacagcgggggcgcggggttggccatccccttctcggtgtcgcgcctggcctggcacgaacgcccggccgccgacgcggagctgtgggcccacgtgcgggttcggcgcgacgccgatggtgccgggctgctgcgggtgggctcggccgacatccgcctgaccggtccggatgggcggacgagcgtgctgatcgaggacttccggttccggtacgcgccgcgcgcgctcgtggaggcgtcgctgagcgcccgggcggaggtgcggcgcgtcgactggacgccggtcgtcgatgacggcgaacggccgggcagcgtgacggtgctcggttcgccgccgatcgagaccgcgttgcgggaggccggtctgcgactcaccggcctcgacgccgacgtgctggtcgacgcccggttcaccgccgatcggccggcccccgcgcagatcgccgccgaggtgacccggatcctccggacgctgccggcggatcgcggctacgccttcgtcggcccgcccggaccggacggccgccccgtcgtggaggcgatctccgggctgttggccggcctgcgggccgagcagccggaccggcgggtgcgcgtcgtcgagccccgcgaaggctggcgcccggagcacctcgcggccgcgctgaccgcggcgatcccggaggacggcgtactgctcgccgccggcccggacggcctgcgcgcccggcatctgaccggcctgcggccgccggcgtcaccaccggtctgggacacggccgggtcggcgctgatcaccggcggcctcggcgcgctcggcctgagcgtggcctcgttcctcgtcgcgcgcggcgtccggcacctcaccctgatggcccggtccgggcccgacgagccggcccgtcaggtcctcgccgacctggccaccgccggcgcgaccgtccaggtcctcaccggcgacgtcaccgacccggcggactgccgcacggcggtcgagcaggccggccgggacgcgcccgtacgcttcgtcctgcacctggccggtaccaccgacgaccgggccttcgacgggctgacgccggactcgttcgactccgtcttcgcggccaaggtcaccggggcggtccagctcgccgccgcggtcggcacccggccgctcaccgcgttcgtcctgttctcgtcggcgtcggcggtgctcggatcggccggtcaggccaactacgccgccgcgaacgggtacctggacgggctggccacggtgctgcgcggagccggcgttccggcgaccagcgtcggctgggggccgtggagcacccgctaccgtgacgggctcgccgacacccccgcggtacgccgggcgatgagcgtccgtgggctccgcgccctcaccgatgagcaggcctggccggtgctcgacgcggtgctggccggcggccccgatcggctggtcgtcgtggccgggggcgccgagccggccgtcccaccgtccccggcgccaccggccgcggcgaccgaccgtggctggctgcgcgaccggctcggcgacccggccgggctgcgggccgcgatcgggcggatggtgggcgaggtgctcggcgacccggggccggtcgaccccggcctcgggttcatggacctcggcctcgactcgatcatgacggtcgacctgcagcggcgtctctcgcacgcgctcggccgggacctcccggtgaccgtggcgctcgaccaccccacggtcgaccggctggccgcccacatcgaacccgcggtggccggggaggccaccgagccggcggacgacctcaatcggctcgaccgggacgacctcgatccgctcgaccgggacgacctcgatccgctcgaccgggacgacctcggcgagatgtccctcgacgacctcgtccgcgcggtccgcgccgacgtcgcgacggaagggtgagcacatggaccagcaggagatccggcagctgatggcgacccagctggagaagtcgcgccggctgcaggcccggatcggtgagctcgaggcggcgtcgcgcgccccggtggcggtggtcggcatgggcctgcggctgcccggcggggtgaccacgccggaggactactgggacctgctgcaccgtcccggcgacgcgtcccgcgagatcccggcggaccgaccggggctgcgcgcggtctacgacccggtgcccggccgggccgggcggtcgtacgtggaccgcgccggcttcctcgacgacgtggccgatttcgacgccgagttcttcggcatctcgcagcgggaggcggcacggctcgacccgcagcagcggatgctgctcgagacggcgtgggaggcgctggagcgcgccggcgtcgcggtgcggcgcgccgaccggctcgacgtcggcgtctacctgggcatgatggcctcggagtacaacgagcggttcgccgaccgcggcgacgccggccgggtcgacccctactacaccaccggcggcggtctctgcttcggcgccggccggatcagctacgtgatgggcttcaagggcccggtgatcagcgtcgacaccgcctgctcgtcctcgctgtcggccctgcacctggccgtgcgcgcgctacgttccggcgagtgccggtacgccctggtctgcggcagcaacctgctgctgtcggccaacctgatggtctcgctgagccaggcacgggccctctcgcccggcggccggtcacgctcgttcctggccggagccgacggatacgggcgcggcgagggcgtcggcgtgctggtgctgcagcgcctggccgacgccgagcgggaacgccgtcccgtcctggccgtggtccggggcaccgcgatgaactccgacggcgccgcttccgggctgaccgcgcccaacggccccgcgcagcaggaggtggtccgggccgcgctgcgcgacgccggcatcgacccggctgagctcggctgggtcgaggcgcacggcaccggcaccgcactgggcgatccgatcgaggtgcacgccctggccgaggtgctgggcgagagcatccggcggcgcggcgtccccctggcgatcggcagtgtcaaggcacgcctcggccacctcgaggccgcgtcggggatcgccgccgtgatgaagaccgcgctgatgctgcggcacggcgagattccggcggcactggatccggaggacgggccgctcaacgagcacatcgactgggccggcctgccgttcaccgtgccccgcgaccaccaaccgtggccggcggtcccgggcgggcgggtcgcctcggtcaactcgttcggcatgagcgggacgaacgtgcacgcggtgctcgccgccgccccgccggtcccggacggcgacccggtcccgcccgagcagccgcatctgctcaccctgtcggcccgcagcatgccggcgctgaccgcgctggcccgggcggtggccagccggctgggcaaggcggcaccggccgagatcgcgtcgatctgccacacgctgcgatgcgggcgcaccgcgttcccgtaccggctcgctgtcgtcgcctcgaccgggccggacctggcggtacgcatcgaggaggcgctgcggcggccgatcgccgcctagctagctagggcgcaccgccgctgctgcaccggctcggggtgcgcaccgtgcccgagccgggcaccggtccggcccggctcgcctggggtgaccggcggtatccgctgaccaccccggaactcaccctgaccgccgtcgcggccctgttcgaggacggcgccgacctgcggttcgacgccctgcgcggaccgcacgaccgtttcgtcgacgacctgccgacctatccgttccagcggcggcgctgctgggtggacgagccggtgccggacggcccggccgtgaccgccgcgcccgagcgggccgacggcgccgtaccggacgccgccgaccggacggccgtgcacgattacctggccgcgcggctgcgggaggtgctcgacgccgacgagctcgacgagcagcgctcgttcctggacagcggcggtgactcgttcgcctcggtgctgttcgtccagcgggtcgaggaggcttacgaggtcggcgtgcgccccgaggacctgccgctcgacctgccgctggccgagttcctcggacggctggcggccggcgtcacccggcgcaccgggacagcgtcgtgaccggcctgttcgtgcagccccgacgcctggccgacccggagctcaccctggtggtcttccaccacgcgggcggctcggcggccgggtaccacccgctcacccggtggctgccggcgagctgggatctgctgatcctggacatgccggggcgcggcaaacgcgtgcgcgaacccctgccggagacaccggcccggttctacgacgggctgcgccgcgacctgctgagcctgcccggcaccgggccgtacgcgctgttcgggcacagcctcggcgcggtcgtcgcggtggaggcggcgtacgcgctgcgcgagcgtggcatgccgccggtgtgggtgggcgtctgcggtcgtctcccaccgggccggtccctccgcacgcccggcctcgccgccgacatgcccgacgaccggctgctggcggcgctgcacgccctcggcggtctgcccgacggcctggacagcgtgcccgccttccagcggcgtttcctcgagctgctccgtcacgacctgcggatcctcgacgcgcatcggccggatccggcgcgcgggccgctcgccgtgccgctgaccgtcttcgggagcaccgacgacccgctgaccccggttccggagctcgccggctgggcggcggtgacgaccgccccggtccggcagcggatcttccagggcggccacttccccttccggcgcgacggcttccgggagctgggggcggcgatcaccaccgagatccgcgcgctgtcgctgaccgacgggagatgaacggccccatgaccatcgatccgatcatcggcacgcccccggccggcgacctgcggctgctgatggcgtcgttcccgaccggtgtcagcgtggtgaccgcgctgggggagtcggcggttccccgcggcatgacctgcacgtcgctgtgcagcgtgtcgctggacccgccggtcctgctggtctgcctgcgctcggacagcccgacccgggaagcggtggcgagcagcagccggttcgcggtgaacctgctgcatgcccggtcccggcagatcgcccacatgttcggctccggccgggccgaccgcttcgacctgatccagtggcgccacggcgacggggcggccgggccgcacctggtggcggacgcgcacacggtcgccgactgctcggtcatggcgacccacgtcgtggggacccacacggtggtcatgggtctggtcgagcgggtcaccgccctccgcgagcaacacccgctgctgtacggcttgcgccgctatgccacctggcccgactcccctgagccggcctgagcccgccgctagagaggacccccatggtcgcaggacccacccggcacgccctggtgctcggcgccgggctggccggctcgctcgccgcggccgccctggcccgccacttcgacacggtgacgctggtcgaccgcgacgacctcggccccggcgccggcccgcgccggggcatcccgcaggcgcgccagtcccacctgctgatgggcgcgggcgcccgggcgatggagcgcctcgtgcccggggtgctcgccgacctgcgcggcgccggcgcgcacttcctggccgcaccgaccgaggtggccttcctgaccaagtacggctggctgccccgcacaccccacgacgagtacgtcgtctgctgcggacgtgatctgctcgaccgggtggtccgtgaccgggtgctggcccggcaccggatcgacgtgctcggcgcgcacgacgtcgtggggctgctcggcgggccggccgcgatcgacggtgcggtgctgcgcgatcggcgcaccggcgaacggtccacggtcgccgccgacttcgtggtcgccgcgaccgggcggtccagccgggtcgcctcctggctgcgggaggtcggtctgcccgaggtgccggacgaggtggtcgacgccggcacggcgtatgcgaccaggatcttcgacgccggcctgcccccgggccggcgcccaccggcgatcgtcatgatcgccaacgtgaccggtgacgcggtcggcggcgtgttgctgccgatcgaggacggcctgatgaccgccacgatgatcggcatgcgcggctcggagccgccgaccggcgacgccgagttcctcgccttcgccaagcagctgccccacccggggatcgccgacgccctcgccgccgcgcagccggtcggtccggcgcgcgggttccggggcctggtcaaccgccgttcgctcttcgagcggctgccgacctggccggagcggttcgtggcggtcggcgacgcggcggcggtgctgactagctagctagcggcacggcaacacgccgggcctggccggccgcgtgcagcgcgccgtccggcggcgcggccgcgacgcctgggacctgtcggtcagcgacgacctgcgtcatccgcgggtgctcggcccgcggcccggcccggccggacgtctccagaaccggtacgccgaccggatcacccacgtcgcgaccgcccgcccgccggtggctcgggcgctcgtggacgtcatcgccctggcgaagccggtgtcggcgctgctgacaccgcgactgctctgggccgcggcccgcggaccggatcggacacgacggcaggaggccgggaagtgatcgaacatcacgacgtcgcactgagtggagtccgtctgcacgtggcggagcagggcaccgggcccctggtggtgctgctgcacgggttcccggagttctggtactcgtggcgtcaccagctcgccggcctggccgccgccggctaccgcgtggtcgcgccggaccagcgcggctacggccgcagcgaccgtcccgccgacgtcgaggcgtacacgctgccgcagctggccggtgacgtcgtcggcctgatccgggcgctcggcgagaagcaggcgttcgtggtcgggcacgactggggtgccctggtcgcctgggcggtcgccaccatgcggcccgacatggtgcgcgcggtggccggcgtcagcgtgccgccgctggcgccgcgcggcccgcagccgccgctgctcgcggcccgggagcggttcggcggccggttctactggaactacttcgagacgccgggcgtggccgaggccgaattcggcaaggacctcggcacgacgttccgccggatgctgttcggtgcctcgggcagccgaccggccgacgccggtccggtggcgcccctggtgccgcccggcggcgggttcctggacctggcgcccgagccgccggtcaccctgccgccgtggctgaccgaggcggacatcgcggcctacgtcgaggcgttcaccgggtccggcttcaccggcggcctcaactggtaccgcaacctggaccgcaactgggagctgaccgccgtgtacgacggcgccgtcatcaccgtgccggccctgttcgtcatcggcgagcgggacaaggccttcaccggggtggcggcgatggacgccgcggtcgccgccctcgcacccggccaccggggaacggtcgtcgttccgggtgccggccactgggtccagcaggagtccccggagcacgtgaccgggatcctgcgggagttcctggccacggcctgagccggggcgggcccgctccagcaccggagcgggcccgccggtcaggcccgggtgaaccgcaccggcaggtggtgcggcccgcggaccaggatgccgtgacgccacgccagcgcggccgggtgtgcgtccagctccagacgggcgaaggctcgcagcaggccggcgaacgcgatgcggacctccatccgggccagcgcgttgcccaggcagtggtggatgccgtggccgaacgcgacgtggccggtggtggccctgcggatgtcgaagcgctcggggtcggcgaagcggccggcgtcgcggttggcggagttcagggcgaccatgaccgcctcgcccggcgcgatcttcacgtcgccgatcgagatcggttcgagggcgaagcggaacgtcgcgctctccaccgggccgtcgtagcgcagcatctcctcgacggcaccgtcgagcagaccgggatcggcccgcaacgccgccatctggtccggatgggccatcagggcatacgcgccgttgccgatcaggttggtggtggtctcgtgcccggccacgatcagcaggaagaccgtgccgcgcagctcgtcggcgctgagccggtcgccgtcggtgtcggtggtccggatcagcgcgctgagcaggtcgggcccgggctcggcgcgcttctgctcgatgagcgcgtcgatgaagcgggcggcgtcgcgcgcggcggcctgccgctcggccggaacgctggaggagaccgcagcgtcggcccagcggcgcacctccgcgcggtccaggaacggcacccccagcagctcgcagatgacggccatcggcagcgggaacgcgaagtcgtcgaccaggtcgaatcggtcgcccggccgggccagcaccgcctccagcaactcgtcggtgagctgctggacccgctcgcgcaacgcctccacccggcgcggggtgaactcgccggcgaccaggcggcgcagtcgggtgtgctgtggcgggtcggagttcatcatgtggctgccggacgggctcttgatcgggaacgactcgctcgcggagtgccactgcttcgacagccgggtgtcgctgagcgccgcgcgggcctcgtcgtagccgacgacgagccacacctcggcgccctccggcatccagacccggtgaacggggccctgctcacgcaaccgggtgtagacggggtacggatcgcgggcgaaatcgtcgccgagcgcggcgagatcgaggggtgcggtggtcacaattcctccagagcgctgccaaaaatgcgggaatcaggcgctcttcgatgctatggaaggtgaccatgcgaccttctaaaggaaatctggacgacaatttcccgtacgcgatgatcaccccttcccggtcagcgtccgacggtctggcgcagcagcccgtcgacgatcgcgatcagccccggccggtgcatgtcgcgcgaggtcagggccggccacagttcggacagtgaggacaggcgcgggaactgctcggggtccaggttcgcgaatgccttctcccgatgtgcgccggcgtcgggtcgggcgtaacgctgttcccgagcgacgcgcagcatcagttcaccggcggtgtaataccagatcacccgataggcgtacacggcttcttcgggcgtcatgccgcagcgcacggcgccatcgatgatattctccactatccacagggcggacaccgccatcaggtcgtcggaggcgagcacctcgacgatccacgggcagtcggccaggatgtcgtacaacagctgggcggccttgatcaggtggtcgcgcgggtcatccggcatgtcggtgcgcgggaactgcccggcgtgcgcctccagcagcaggagcaggagctcgtccttgtccttgacgtggtggtagagcgccatcggggtgctctcgaggtctttggcgacgcggcgcatcgagaggttcttggcaccctcctcggcgaggatccgcttggcggcctcgacgatggcctcccgggacaggcggggagggcgtcccatccggccgccacgcgacggggaagactgcatactgctcggtaccccctaccgttagaggacgccttcgacctgctccgccgatgccgtcgaacacgggacgtccccggtgaaccgcaccaccgtatccggcagacggcgctgaagggcggccagtagccgccgcgagtcgacgacgtccgaggcgtaccggacaccgggccgcacctgcccgcccagcacggacagcaccgcctcggccgcgaccacaccggtcagggcggagccgtccgtcccgcggatcaccgccgagcggtgcaccggccggccgtcgtcggtgtatccgtcgagctcgccgtgcaacacctggtaggggcgacggccggcggcgtcgagccggctcgcccggacgagctcggcgatcgcctccgcgccgggcggcccggccccgcgtcgccgggtcgtcgcggccagcaggtgcgggccgtcgaaggcgttgaaccacgacgcccgggccagcggcagcatgagcgcctgccggcgcagctccgcggtcaggtacggatatccggtcagcgcccggtcgacagtcggcacccggaagtcctcgtcgacctgcagcgcccgcggcacctcccgcccgtgccagccggccagcgcgacgccgtacccggcgtccagactgagcaggtagtcggcggcggcgccggcggtgaggccaccgaggcccgcgtacgccccggtgaagctcagcggcccggtgagtccctcggccagcaggcgcggcagcatcccggacagacccggcgagacgcccgcggccagcacgacggtgcgcccggcgggcgggggcggcgtccgcccgtcgtccatcaccgacacgtagtcggcgcccgcgtcgacgacggcggcgcgcacccggtccatcagcgtgtacgccggggccgtgcagtccaggacgagacggcagccggtggcgaagcgccgcaccgtggccgggtcggtcacgtccacggccaccggccgcaccccggcccgcgccgggcccgggcggcggcaaccggccctcacccggacgccacccccggtgagcaggcaggtcaccgcgaccgtgcccaccgcgccgccggcaccgagcaccccgaccagggccggctcacgcatgctcgccccgcggcacggcgaggcgcacggcccgggccacggccggcacgttcggtggtcgcatgcaggtgaagtgatcaccgggaacgtcgacgatgcgcagctcaccggtgcacacgtcgcgccagtagtcgctcatgtcgcggtgcatccccgggaagacctgcgcctcaccgctctgccggacgaaggtcaccggaccgtcgtacggcgtgggccggtgcgaggcgaccgcgaccaggctgtgcttgacgatccggaactggcggcgcagccggtccacggaggtcagcccggcgtcggagaccggcatggccgccccgatcgcggtcagccgctcatcggggtccatcgcggccaggcgccggaatccggcgaccgtctccgggcgtacgccgttttcacccggctcgagcaggctgccctccgggacccgcccgccgtggcgggcgaccgccccggcgacgatccgccgggtctcggtctcgtcggccgggtaaccgagccggatcgggtcggctcgcatcacccgggcgaagatgtactcggccagcaggtcgtcctcgaccaggtagggcacccggtaactgctgacgatcgtggtcgcggcgacccggatgccggccgccgtcagccgggtggccagctcggtgacgagcagcccgcccatgcagtaaccgatcaggtggacctcctcgtggccggccgcgaccagggtggcggcgtgccgccgggccagcgtgccggtcagcgtgtgcgggtcgctgtcgaggtactcctgctcgtcgtcgaggacgaggccggccatcggcacgtcgggggagagctcccggaccagcgcccggtaggggatcagggtgccggtgccgtcgtgcacgagcacatgcagcggctgcccggggccggcggcgggccggcgggcccggtcgcccacggagaccagcgacgacggggccggcgccggcccggacgactcgagcgagcgcaggtaggccgcgatgtcggcgatcgtcggccggttcagcacccggcgcagcaggtggtcccactcgacgtcgcgggcggccggcacccggtcccggatccgcccgaccagctgggcgacgagcagcgagtcgccacccgcggcgaagaagtcggtgtcccggccgatccgggtgaccggcaggatcgcgcaccagatgtcggccagcagccgttcggtctcgtcggcgggcgccgacgccgccgagccggccgcgtgccgcccgccgcggaccgtccaccgggccagccgcccgcggtccaccttggcgttgccggtcagcgggatccggtcgagggtgtgcagctgggccggaagcatgtactccggcaggcgttcggccaggtgccgctgtacgtccgcgacctccaccggcgcgcggtcggccttgaaccgggacacgaagacgtgttgcccgatcagcgacagggcgtcgtcggcggccggcagtgtggccaccacctcggcgccggcctcgtcgagcagggacagccaccggtcgcggggcacgaacgtggtcccggtctcccgccgctcgtcctcgaacccggtgagcccggcattgaactccatcgaggtcatcacgtggtacgcgtcgcgggtggcctcgatgaagacgagccagccaccgggccgcaccaaccccttcagcagctccagcgcccggccggcgtgcaccgcgttgtgcagcacgttggccagcaggatcacgtcgaacccgttgtccggcatctgctgctcgacgtggtcggcgttgagatcgaacagcccgaaccggacccaggggtaggccgcgaagcgctcggccgccgcattgaggaagaagtgcgagaggtcggtgaacaggtactcgacggcgaggtcgtccagcgcggggatcagctcggtgctggtgccgccgaccccggcgccgatctccaggatccgcagcgggccaccgccggagtgcccggtggcgatcgtgcgcagcgcggcgatgacggccgcgttgttgtagcggctgatcaggttgtcgcggtacgcggcctcggcggtgtcgagccgcccgtgcgggaacagcagcgtcttgaggtcgatgtcgttgcggaccagcgcctgcaggttctcctcggaggtccggtgatagcgcaccagctcggcgccccaccggacggccggttccaggacgtcgacgcggtcccgcaggcgcttcgccgcggcctcgtccggccgggtcaggccgtggtacgcgccggtgtccgggtcccgtcggacgaggccctcgtgctccagggcgcccagccatcgtcgcaccagataatggttcgccggagcggccttgaccgtctcgatgatctcctggtcgctgtgccggctcccgacaccggcgaacagcccgcagtccaccagcagtcggctgatcgactgcagggcggcacggtcgagcagctccaccatctcggcgacccgaccccggtcgacggcgccgatgcgcgccgcggccgccgcggccatggtctcgggcagccgctccggcagcggggcgcggtccgccgccgcgggttcgacgaaggcggcgagatggcgtccggcctcgtcgtcgtacgggatcaccgcggccgcctgcactccggggtgggcgagcagtgccgcctcgatctcggcgacctcgatgcggtgcccgcggatcttgatctggccgtcctcgcgcccgaggaactcgatctccccgtcgggaagccgccggccgaggtcgccggtgcggtacagccgccgtccgtcgcgcgggtggtcgacgaaccgttcggccgtgcgcgccgcgtcgccgaggtagccgagggccacgccggcgccgccgatgtacagctcgccgaccaccagctccgggcactcccgcagcacgtcgtcgaagacgtggaagctctggttggccagcggtcggccgtacgggatgctcggctggtccgggtcgaccgcgccgacacggtggtgaatcgaccagatcgaggcttcggtcgccccgcccaggctgatcacctcggccgagggggcgtggcggcgcacggtgtcgggcagggtgaccgggatccagtcgccggagagcatgaccacccgcagccggctcaggtcgtggccgggcgccgccgccagatactcggtcaacagctgcatctgggcgggcaccgagttccacacgctgacccgctcggtgaccatcaactcggcccagtgcgacgggtccccgcgccgttcggcctgcggcagcaccagggcgccgcccaccgacaacgggccgaacacgtcgtagaccgacaggtcgaagccgagctgcgcgagcccgaggacccggtcgtcggcgccgacgccgaagcgccggttgatgtcgtcgaccgtgttgcgggccgcctcgtggctgatcatgacgcccttgggcgtcccggtggaccccgaggtgtagatgacgtacgccaggtcgcccccgacgggcccgggcgcctcggccggccgggccggtgtcgcgggcagccgatccgcctcgatcgtgaccacgcccgacccggccagctccccggcgtggaccgcgtcggtgacgacgaaccgggccccggcgtcgcgcaggatcgtgtcccgccgccgggccggttgccccagatcgaccggcaggtaggcggccgcggcgagcaggattcccagcaccgccacgacctggtccgcgcccttgggggcgacgaccccgacccgctcgcccggctcgcacccggcgtcgcgcagcagcccggccagcgactcggcccgggcgagcagctcgccgtaggtcagcgtgcacccggccgcgatcacggcgacccgtccggggtcgcggcgcgcccggtccaggaacgccgcgtgcaggggcccgcgcacccgcggctcggcggtgtcgttggccgcggccaccagctcccgctgccggcggggcagcacgaccgggtccgcctcgtcgacggcgtcaccgtcggcgagccgctcgacgagctcggtgaaggcggcgaacatgtcggcggcgaccccgtcgggcaggacgccgtcccggacgtcccagtgcagcagcaggccgccgtcctccgccatcatctggcagtcgatccacacctgcggcgtctggctgatcccgtacctcaggcgcgctcccggcatcaggccggcgccgggcgtcggggcgccgctcaccgtgctggtgaacgtcaccggcagggccgcggccgcccggccccggcggcgcgcgatctcccgcagcacctcgacgccgccgcagaggcggtgatcgaggtcctgccacagccgtccgtgcagggtggccagacgctcgccgaacgccgcgaccggggtcgtgtccacgtccagaaggctgaccgagctgaagtcgccgatgacccgggccacgtccgggtgcagtggcagccggttctgcacggtcaggctcagggtgaaacgggggtggcggctccaccgcccgatcgtctcggcgtaggcgcccagcaccgcggtggaggcggtgatccccaggtcggtcgcgcgccggtgcagttgctgccagcggggcccggccagccgggtggcgaagcgggtgaagtgcggcgccgcgagtggcgcgtccgcgcggaccggcagctcgggcgcgggcggcagctcgtcgacccggctgaaccagtactcacggtcgcgccggtgacgttccgtctccccgatgccctgcagggccaggacgtagtcgcggaaggtgacggccggcgcggcgtcgccgccctcgccggtcacctcgcgccgcagctcgtccagcagcagccggaagctgctgtagtcgcagatcagcaggtcgatcgagaagtgcagcagcagaccgtcgggtgtgctggtcgcgcgcagatcgaacagcggccaccgatcggtgggccgcacccggtgggacagctgctcgcgcacggtggcgatcgcctcccggaccgcctccggcccggcgtcacgcagatccgcgtgtgcgaccgggtaatggggcacctcggccgcgacctgctggaatccctcggccgcgacggtcgcgcggagcatggcgtgccgggccaccagtcggttccaggccgcctccacctcgtgaaccggccagtccgggacggccagctccaggtaaccgtggcaggccaccccgccgaactcgaacgcgctgccccggccgagcagatacgccgactgcacctcggtcagcgggaacggctcgccggcccgctcggggtcggcggcgagcgggccgccgaactcgtcgccgtccgcgcgcagcaccgccaggacgtccggtttgtggtcacgcagccagcgcagccgttccggggtggccacgcccttcggcgcctgatagcggaggtcgtcgccctcggcgtacagcaccatgccggccgcccgcagggccgccaccgtctccacaatggccatgttcttccttcccggaagcccgttgtcactgtctcgacacacccttgcaaaggtgactggtgaatctctggagaccggtcccggcgccgcttcgcggttaccggtcgaccgcgaacttccgggaattcccgcgcggacccgcctgcgagcctggagcgaccgacgtcaccggcgggcgtgggcgccgccgaggccgtgccaccagcggcgccggcgcggtgcggcggccggtgtctcgtccggcagcgtgcccagggtgaggctgacccgggcgccgccccattcgttgccgctcaccgtcagtgtgccgccggtgtcggcggcgagccgctgggcgatgtcgagccccaggccggtggagttggcgtcgctggcgccgcgggccagtgcggcgtccgggtcggtgaagccggggccggcgtcgtcgacgatcacggtcgccgacccgtccgaccggacgacggtgacccggcaggcagcgtcctcgccggtgtggtggaagacgttgccgagcaggacgtccagcgcttcggtgacccgggaccaggccgccggcacggtgagcccgtcgggcggcgggtcggcctgccacggccggccctggtcctcggcgagcgcgccccagaacccggtacggtcggccacgacggcgccgagatcgcactgcaggcgcggccgggcggccaggggacggctcgcctcgctgatcaccgcgctgatctcgtactccagccggtcgacgacccgcagctggcggtcccggtcctcgccggcggtcagcgcctcggtgttgagtcgcagcgcggtcagcggcacccgcagccggtgggacaggttcgcggcgagcgcccgctccttcgcgagcagctccaggaaccggtcggcgagcaggttgagggccgcgccgacctcctcgatctcgcgggggccgctggggcgtacccgggcatgcagttgacccgcgcccaggctggtcgcggtccgtgccaggtcgcgggtggaccggacgatccgggcggccagccggtcggcgagcgccatgcagagcccgaccagcaccaccgcctccaggacgaggaccagcaccgccgttccgacgccggcccgcagcgccgtgcccgggacgaacacctcgatgaccgcgatcagtccctgcggcagcgccaccggccgcaggtagacccggccgccgtcgacatcgacggtgccggccgtctcccgctgccgcacctggatgacggcgtcgggcgtgacccggctgacgccgacggtgcccagggtgggcaggtgcgcggcgagctcgccgttctgcccggcgcgggtgctcatgatcgagttgaggacgaggtcgcggtcggtggcgaccaccaccacggcggagaggccgagggcctgtcgttcggcctcgcgcatcgcacggtcctgcacggcgctgtgcaccagcagcgcgagcgggatgacgaacgccagcgccaccagggtggtgacggcgagggcgaccagtgcgtaactgcgtctcatgcgccgtagtcctcgatgacctgggccgccgggccatcgttccagtacgccgtgatggccgaggtgtggccggggcgggacagccgcgccacgacgatggtgtcgctgcgccggacgacgtcgaccgtgtaaccgggcagtggatcggcgccgaccacgtccacccgggtcgccgaataggcgacggtgatcgtcccggcgtcggcgttgatccggtaccggggccgctggtccaccgtcggcgtcggtgacggcgagggtgccgacgggggccgggcgctcggctggcggctgggcgtccggctgtgcgccggcggtgccggggtgtgcgacggaggggacttcgacgggccgggcgcggcccggctcggcgtcgcggactccgcgagcccgaaccggatctcggtgtaacggcggttcacgtcgatcgccaccggaggctcgtccgtgatcgccggagccacgccgagccggacaccgaaccaggagacggcgaccgcggtgatcgtcaccgcgagccaccccgcaacataactccagctccggcccatggtcgtattctgcacgagcgatacggtgaggcaatgccccaggtgttggtgatcgaggacgacgtcgacgtccggcaggcggtcggccggttgctgagcgcgaccgggcacgacgtccggttgtgcgcgacggccctcgacggtctgcgcgaggcggccgcgtgggcgccggacgtggtggtgctcgacctcggactgcccgatctcgacggcgcggccgtcctgcgccggatccgggccacctcgcaggtgccgatcgtcgtcgccaccgcccgcgagcaggagagcgagatgatccggctgctgcgggccggcgccgacgactatgtggtcaagccgtactcggccgagcagatcgaggcccggatcgcggccgtgctgcgccgcggccacggcggcccggcggccaccggcctgaccgtgggcgggctgtcactggatccgcaggggcgcacggccagcctcgacggggtgccgctgcagctgtcccggctggagttcgacctgttggcgtacctgatgcagcgggcgggcacggtggtgacccgccgtcagctgctgtccgacgtgtggccggcggagagccgatcgctggagacggtcgacgtccacgtcacctggctgcgccgcaaactcggggaacgggccgcccagccccgctatctgcacactgtccgcggcgtcggtgtccgcctctccgcgccggaacccggccgataggacccgtcgcttgtcaccgcgacgacgctcaccgtcacgtaccgcatcgctccgataaaggttcccgtaagggctccgtaaggaactgaaacggaacgcttccgagctttaatcatgcattaagtgcattgaccgagatattgcttcgacgaagacttgcaacggctcggaacacgagcgaatccctcacttcgcgacggcggacgactgggcacgacccggagaacggccccgcgagtattcgtgcaaggagcatcgttgaagcacaaagtcgcggtggcgagcggcatagcggccgtcaccgtagcgggatcgatcgccctgaccatgccgcagggcaacgccgctaccaccccgagccaccagcagcccgcggccgacgggccggcgccggtcgcgctggccacgtcctcggccgcggacctggttaccaacaaacccaagaccttcttcaagagccggtacgacaagctcgaccggcgccaggtggtcagccagaacggcctgcagtacgtggtgtacgaacgcacctaccgcggcctgccggtgcacggcggtgacgcggtggtcgtcgccgacagccgcggccgggtgctcaacgagtacgtcgcgcaggagcaggcgctgtccatcccggtcaccgcgaagatctccgcggccgccgcggcgaagaccgcgcgcaagcagctcgccagggtgaccacggtgtccccggccacgttgcaggtcgtcgcgcagggtgccggtgtgctggcgtacgaggtggtcgtcgccggcgccaagcgtgcccccggcggtctggccccgagcaacctgcacgtcttcgtcgacgccaccacgggcaaggtgctgcccgacctgacccgggacgacatcgtcgacgcggccgggcacggcgcctactacggcgacgtcctagctagctagcaggctggaaccacgccaaggcccgggccgcctcggtcgccgcggccgcccaactgttcggcaacggcaccgaatgcgccaccgtcaaagccgcctgggacgccgtcagcgtaccggccggcaccggcgaaccgtcctgcaccggcgccgggaccccgaccaccggtcccaccgccaccagccccgctccgacccaggcacccaccggtgactgccaggccgggttctcctcgcacgacagcggtgcggtcaccgccggccagaccgtcgtcagcgacaccttcaccgccggcggcggccgccacagcgcctgcctggccggaccggccgggaccgacttcgacctgtacctcgacaagttggtcagcggccggtggacggccgtggcccgctcggtcggggagacgtcccgcgaggcgatctcctacaccggcacggccggcagctaccggtaccggatcgtctcgtacagcggctccggcaacgccgttctcggctggaacgtccccgccgcgagctgaccatcgggatcgggccggggccgcgcaccagcgccgtcccggcccgatgccggcctgccattccgacgatcctggagagaccgcggtgcgacagtcacacatatcggtagtcctcgcggcgctgctgctggccggagtcgccggctgcgccaacggcgagccggccgcagcgccaccgccggtggccgcctcgtcctccgcgacaccggcgtcctccgccatgtcggcgcccacggcttccgcggcccgtgccgtcccgctcaccgtcacccggcgcggcggcttcgccggcgtcgaagagagcgtctcgatcgccgccgacggctcggccaccgccacccgcaagggtcaggcggccgcgccggtccgggtgccgaccgccaccaccaccgagttgcggcggctgctgggcacgccgggcctggccgcgcaggcgtcgccgtcgcccggcgcgccgggctgcgacgacggcttcgagtacacgttcgtcaccccgtcggcgaccacggtcgtgcaggactgcgagggcgggcacggggccaccctcgaccggctgctgaccctgggcgccggcctgttcgcccactgaccgccgggcggcgtcaccggcagccgtcctgccggtgacgtcgcggcccatggccgctacgccgcgactacccagttgcccttgccgcggtgcttcgccgcgtacatggcctcgtcggccgcgagcagcgcggcccgccgcgcatcgggggacgtggtgacgtgcgcggcgatgccgatgctgacgccgacggcgagctgtcgcccgccgaactcgaccgggcgcgacacctccgtgacgatccgctgcgccaggtcctggccgtacgtgacgtccgccgcggtgcaggcgatgacgaactcgtcaccgccgagccgggccaccaggtcgctgctgcgaaccgccgcggtgagccgctggccgaccgccttgagcacggcgtctccggcctcgtgaccgtcgcggtcgttgattgccttgaacccgtcgaggtcgaggtagagcagcactccggcggtgtcctcgtccaggtgctcggtgaaggcggcacgattcgccaggccggtcagcgggtcgtgccgggcctggtaggccagctgggcctgggtgcgttcgagcccgcggacggcctgcaggaagcggatcagcacgcaggcgatgcaggcgagggtggccgccatcaggatggtgcgaccgccgggacccaggccggtgtgcgtgagcacgaccgtgggcgcggtggccagggccgccccgaggaagagcacccgggcggggtgcagcacctcgacggcccggcccggctcggtgagctcgccgcggcgggggtgcaaccccgccgcggcgagcaggcagttgccgagcaggacggcgccgtccaggtcccacgagacgtcgctgtgcaccacgtacatgaggacgttgttggccgaatcggtgagcaggtacagcgtcgcggcgacgagcatcaggtaggtgggtccgccgcgtcgcccgggggagaggaacagcatgagcacgccggcgagcagcatgacgtcgcccaaggggtacagggccggtgtcacgctctccagggtgctgaagccctcgtcgatgatcggcaggcagaagtagacgtacgccgcgatcccggcggcgaacgtcagcgtcagcccgtccagcacgacaccgcggacgcggccggccgcccggtagcgggccatcatcaggagggcggccgccatggcggggtagccggcgagccagagcacgtccgagagcccgaacggcggcacgtagccggcgtagtactgcagggtctgcacgccgtcgccgctgagccacagcaccagcgcgagggcgatcaggcaccacggcgcccggttccgtctggccggctggcgcgccgcggtgacacagacggcgacggccagcgggaccgtccaggcgaagtagatgatgtcggaggtcggcgttccccggcgccaccacatcgcggctgccgccagcaccgtcgcgccgagcagcagccagaccaccttgttcttcacgccgcgccatgtcgtcgcagcacgcccgtccttgaggtgaagtggcgtacggcataccgccggagcgggtctctcagcccgtggccggtccccgcgccccgatgcccggcccgcagagcgccccgagcatgaccaacgggtcggtcaccgtcacgctgcccgcccgcagcgtgacgacgctcgtgaccaccgtgggcggcaccgtcccacccggcccggcggccagcccgtcggcgagttcgtcgccggccggcggcgccgggcccgggtggtctacacgatgagcacctggagaccgtcaagatcgggttccaggccactcacaccggcaacaccgccgaaccggccggtttcaccctcgacggggtgccctgcaccgtggtgtgacgcacatgtcgtccagcggcacatcgatgggcgacggggccgccaggccggccggcacccctgcccaccggcgcaccatggcggtcgcggtggcgttgtcggccggggcgaggccggcgatcttcgcgccgtggttcgcgcccggggcgacgaacagcgccgagtcgtggcggctcggggtgaagcgttcggcgctccacggatcgttctgcccgtacacgaagagcatccgttccgaggcggtgcggacccaccagtcgacgtcgagcatcggcagcgggtggtggacccggcgcagttcggccggcagggacgagttcgcggtgtagaggcccgggtagtggcgcaggccgcgcaggtgctcgaaccgcaggctgggccagcccagctggctcgccgcctggtagtagtacggccagtagtactccaggccctggtcggtgtagaagctccacccggccacggcgtcggtccaggcgtacaactcgtcgtcggtcgccgtggccggcggcaccgccgcgcagtcggcggccgtgctgtactgccagaacgcccacaccgagtccagcacggtcatctcgaacgagcggtccgcggtgcccagcgtgcgggtgaaggtccagccctgcgccgcggcatccgcttgcaggtgggcgaccagccgggtccggcgccgcagcgcttcgcgctgcacctcgtcgagcgcggcgcggcaggaggcggtcccgacggtgtcgaagaaggcgtcgtacgcgcggtcgaccggattgatcgcgtcatccggtgccacataggcgaccacgccgtcgacgtcaccggggtagaagcgccggtggtacaccgaggtcatgccgcccttgctgccgccggtctgaatccagcgaccggtgtagacgccgcgcagcgcggtgacgatccggtgctcgtcggaggcttcctgccagatgtcgagatccgaccagtcggccggggccgggcgcgacggggtgaagaagcggtgctcgaccgacacctggttggcgcccagcagcgccgtcggctcggtctgcgtcggacgcggactggcggccaggccgtacccgctggtgtagaggacggtgggcgcggtggtcgaccggtgcagcagggtcagccgctgctcgtagccaccccgtcccggatggcggtgatcggcgggctggcgataggtcaggacgaagaaccggtagccggcgccctgggtgtcggagacgacggtgatgccggggatcgcggtcagctgatcccgcagcgggtcgtcggcggcgcgtgccggcgtgaccggggtgacggccaccagcaggcaggcgaggatggcgacaagacgttttcgcacgccgtcatgctatcgataaaccctaatacatcaacgggtcatccgacggccatctccggccgcttggttgcggggatgctcctgttcacttctcgcgcccgcaggcgggcggcagtcgtcggcggtaccaccgccgtcctcgttcttgcctcgatcggcaccgcctgggccgacccgttcggctggcgaggcggccgccagcatccgttcgccgtgcggccggacaccggtgccgcgtccgccaacgtgctggccaacgatcgcggcgccaccgcggtggtgcgcagcaccggcctggacgacccggcggccggcagcttggcggtgcaccccgacggctcgtacgtcttcacgccggcggtgccgggaagccacggcacggtgcacttcggctacaccgcgaccgacgcggtcaccgtctactccagtgcggtgcggggcggcgcccggattccgccgctgggcggcctggagggtgcggacggcagcaccgtgccgatctccggtggcggttacggctcctcgttcgtcgcggcgccggggcggcccggctggttctacggggtcaccgaccgcgggccgaacgtggacgacgacggaccgagcgggcagaaggccttcgccgatcccggattccacccgcagatcgggctgttccagctggccggtggcagggcggtgctgcagcggacgatcgtcctgaaggcgccggacggcaccccgtacaacggcctgccgaatccggtgaccaagcgggccgcgagctccgagaagaccgaggacctgtacggcgactacatcgacccggcgcagccgtacacggtgcccggcaccggtccggcggtgaccctggacccggacgacggctacgactccgagggtctggtcgcgctggccgacggcagcttctgggtctccgacgagtacgggccgttcctcacccacttcgaccgggacggcaccgagatcgagcggctgtcgccgtggggcgccgacgccgggcacaacgtcgacaccgcgcacccgctgcccgccgagctggcgctgcggacgaagaacaagggcatggagggcctcaccgtcaccccggacggtcggaccctggtcggcatcatgcaggcggcgctgaccgtgcccgactacggcaccgacgccaagggtaaaaccgttaaaccgggcaacgtctcgccggtccgcatcgtgacggtcgacctgcggacccgggccgtccaccagtacctgtatctgctcaccaacccgaacgccacgggcggtgcggtcagcgagatcaccgcgctgtcggccacccggttcctggtcgacgagcgcgacggcctgcaggccgggccgggccgggcggtggccaagtacctgtacgagatcgatctgaccggcgccaccgacgtcaccggcaccggcccgctcggctacctgatcggcggcacatcgatcgaggcgtacgtcggtgacgcccccaccgcgaaggccgcgctgctgctgtcccaggccggtgtcatcccggtcggcaagagtccgtacctcgacctcggctccgtgctgaaccagctcgacccgtccggcaggttcttcggccacgacaagatcgagggcgtcgcgacctccgacggcggccgcgtgctgtacctcgccaacgacagcgacttcggcatcgaccacctgctcggccgggacgaggcggcctgcgaggcgtccgggctgtccgacaccaccgcctgcgcgccggtgaagtcggcgaccaccgggaagttcctcgtccaccagaagacgctggacgccgccggcgtggccgacgacggcgaactgctgcgggtcgacctggccaagctgccggtggtgctgggcagcaccacggtcaccatccggtactgagcccgcacgacggcggcccgttcccgcgggaccgggccgccgttcgggaagactcagctgcaggcggcgccgttgaggcggaagccggtcggggcggcggcgttgccggtgtgggtggcctggtagccgatggtggtcgaggctccggcggcgagggtgccgttgtagccgacgtcggtcgcggtgacggtgccggtggcggggcggtaggtggcgttccagccggaggtgatcgtctgtccggcggccagggtgaaggtcagcgtccagccgtcgaccgccgtaccgccggtgttgacgatcgtgatgttgtcggtcagcccggtgttccaggcgctgaccgcggtggtgacccggcaggcgccggtcggggtgttggacggcgaggcggacggggtcgccgacgggctgccgccgggcggcgggctcgtgctggtgccgccggccgcgctgatgatggcgtcgatgatgctctgctgggtgaccgtcgcggagctgcggttgaacagcccgaagccgtacgccccggtgtagccgttgtcccagtacgcggtggccgcgccgtacttcttggccgcggtgaccagggcgcgcgcgtagtcggcgcggtaccggttgttggtggggtccgccgcggtcttgtcgatcgagccgtactcaccgaccaggaccgggtagccgcgcgccacgaacgtgtcgtgcaccttcttcagctggccgtcgaggtagtcggcctgcccccaggtggacgtcttcgcggggttggtggcattcgggccccactgggtgacggtgccgtcctcctggccggtgaagtcccacgggtcgtagtagtggaccgagatcatgatccgctgctcggtgccggggatcgacgtcgaccggtactggtcggtgggcagcgcgaatccgtagttgccgaccgtgtagtcgatgttggtgttccagccggggacgagcagccagcgcgaggcgttggtgccaccggtcctgcggaccgtgtcgacgaagatctggttgtacgcgttgatgttggagtagcacggctgcgtcgggttgccgtactggccgtcgaactcctcgttcatcgactcgaggatcaggtgctcggtgtagctcgcgaacctggtcgcgacctgctgccacaccttctggtaccgggccctgaccgtcgtctggtcggcggcgtcgcagatcagccacgagcccgtgacggatttgtagccgtcaccgtgcatgttgatcaccacgtacaaaccctggttgtacgcgtagtcgaccacctcctggatccggttcagccaggtggcgtcaaccgtgtaggtcggggcggcgccgatggcgcccaggtaggagaccggaatccggatcgtcctgaagccggccgccttcacccggttgatcagggcctgcgtgatgaccgggttgccccacgccgtctcgccggggatgccgttgttgctggcttcgagctggttgccgaggttccagccggcgcccatgtcggtcaccagctgaggagtggtcagcggggcggccgcctcggcggacgccgacgccgacgtcacgccgtacgcggctccggccagggccagcgcggcggcggtgaacgcgagcccggcctttcttgccatcgatctcatggggcttcctctcgtgcggtccgcggcgccgaaacggcggtgaatccgtttcgcgcctcgccgagaagtgtcgaatgggaacgctcccaggtcaatcgaaccgcttcgataacgcggccctcggggaaggaacggcctaccggagccggaggtcccaggtcagctcccacacccggaccgtcgtgtcccggcaggcggcgaccaggaaacggccgtccgggctcaggcaggccgcggtgatcgcgtccggccggtccgcgggttcgaacagcgggtcgccggtcgcgaggtcgtgcagactcagcaggtggtcgcccgcggccacggcgtagcggccgtcgtgactgagctggacgtcggcgaggtgcgaccagtccggcggctcgaaggcgcgcagccgatcgcccgacgcgaggtcccacagcccggcgcggccgtcggagtcgacggtgaggacgctgccgccgtcggcgctgagccgaacgacctccacttcttcggggtcgaggacgcgcacacagtctccggtgtccggatcccacacgcgggccgtgccgtcgtggctgccggagacggccagccgcccgtccggggtgatggcgacggtcggcacgccgccggtgtggccgtccaggcggcgcaggcgggtgccggtggtcaggtcccacaccagcaggcggtcgccgtcgcgggcgctggacaccgcccggcggccgtcggcactgaccgccaccgagtacacgacgctgccctgcccggtcagcgtgcgcacacacgcaccggactcggcatcccagacccggatcgtcttgtcgcggcctgccgagacgatcgtacgaccggtgccgtcggtggtgaccgacagcaccgagccggtgtggccggtgagcgtgcgaaggcacgcgcccgattccaggtcccagatccgcagcgtgccgtcgcggccgccggagatcgcggtgcggctgcccgggacggcgcagatcgactcgacgcggtcggtgtgaccgtgcagcgtgcgcgtgaccagcacgtcctcgaccgcgacgcggtcgatccgggcgctcagccgctgccaggcacgcagggcacgcggcgtccgatcatgccgccggtcggtgcgcaaccggaccagcagggcgtgcgccgtgccgaaatcctcctcggcgatcgcccgctccgcccgatcgaggagggtgtccgcctcggcgttgatcacgacgattgcggcgtacgagcgtggcacgcacggctggggcggcgcggcatagccggtgggcgccgggatgtcccacacccgcaccacgccgctcaacccaccggccgccgcggtccggccgtccgcgctcagcgccgccgtgtcgtcgtagtcgctggtgaacgtgcgctggcagcgcccgatccgcagatcccagagccgcacggtgtggtcggtcccgcccgccgacacggcgtaccggccgtcggcgctgacgtccagcccgcgtgcctcacggacatgcccggtgagccgatggcggcactgtccactgtcgaggtcccagacgcgcagcaccgggtcgaactggccggcggagacggccacccggccgtcggcgctgagccggatcacgccgacgagggaacggtgcccttcgaggtgtgccaggcactctccggtccgcaggtcccacagccgcaggacacggtcgaggccggacgacacggcccgcgtcccgtcggccgacaccccggccccgatgatcggtccgccggggtcgatcacccgcagcagccggcccgcgtgcaggtcccacacctgcaacccactccgcaccgtgatcacggcggtccgtgcctcggggtcggtccagatgtcgacgacccggtcgccggtctccagccgtcgccgcagcctgccgtcctcagcggtgcgccacgagacggtcccgtcgccggtgccggacagcacgtgccccccatccggggtgaggtgcagggcggtggccgtggcggtgtgctcgtgcgcctcctgcaggcatcggcccgtcctggtgtcccacacctgcaccgtctcgttcccggcggtcgcggcgatccggccgtcggcgctcaggcgtacgtggtcgacctgccggcccgggcccgcgtgcagcgagtccgagcggatccccggccggacctgaaccgtgcgcggctgcagccggtgcgggcgttcggcctgcacggcgtaccggaaagcgtcggtgtccttcgcggtccgcagcagcagcggcagcgcggcggcggcatcgccgcgctccagatggaccagggcgcgcaggtgatcgctgtccagggcggccagcagccggtcgtcggtcagttcgccggtgcgccagcgcagcagaccgctgtggtaggtggcctcggggtgccccggatgcacggccagtgcctggtcgaaaagggactgcgcggcgtcgacgcggccgagcacggtcagcatgatgccgtgatcggtgagctcatccgacgtccgggtgagcgggacaggggccggtcgcgggtagggccggccgcactcctgccggtaggtcccggtcaggcggtcgatgacgtccgccatccgcaggccgtccggcagggcgggcccgcccagctcgcgcaccagtctccggacggcggtcacgtcggcctgccaggcggccgccgcggggacgccgaagccggtgatcttgacggtgccgtccggggtgaccagcacggcgtccggccccaccgcgccgtgggcgacgtcgtggcggtgcgcgtgctcgaggccccgggcggcctggatcgcgatgtcgagggcctggtcgatggtggacacggcgtcgatgcgcagcgggccgccgtcgacctgctcggcgtcggcgtagtagcgggcgcggacgttcgggtgccgactcagcgacatccagcgttccgcggcttcgtcctcgggccgggtgctcatgcgaccgtcagcacggcgaggccctcggcacatccgatcgccagccgggagccggccgcggccagggtgagcaccttgctgcccatccggtgcgagctcaggcggcgccagtccagcggatcccgcaactcgacctcgtcccggcgggcgacggccagcacctgcccgccgccggcgtcggtgagcaggcacgggtgccggccgggtagctcgccgaggacctcccggctgacgacgtcgtggacctggaccgtgccgtcggcggtgccgaccgccagcagtacacggtcgtgcccggccggtgtcgcggccagcgaccacaccggcgcccgctcggcgaacgggtcgccgaccggcagcccggtgaccggatcccacagccgggccgcccagctgccgccgcgtgccggcgtggcgttgctcgcggccagcagcgtgcggccgtccggcatcggcaccgccgcgaccgcccgcagcggcggccggtcgagccgggtgaacatgtcgctggcactggccccggtctccggatcgcgcagccgcaggacgttcacgtcgttgccgacggcgagcagggtgcgcccgtccggcatgacgatcggcgccatcgagcggaccacgtgcgagcgggccgcgggcacctcggcgaggagcttgccggtcaccgggtcccgggagcggatggtgccggcctggtcgcaggtcaccagcacgagccggccgtccggcagggatgccgacgccacggcggtgacagccccggcgtgcccggtcaggggagcgcgggcgggttcgccggtgagcacgtcccagaagcggacgccggtggtcagcaccgtgcggccgccgggcagcgtcaccggcgccagcaggtccaccgggccgacccgttcggcgtcgggcagcggtggtgtctccgccggatcccacagccacagggtgccgtccgggcccggcccggccagcagggtggggtcaccgggcactgccgccaccggccgcgggacgccgttcgtgccggcgtcaccgacccggcggccggaacccggatcccacagcccgcccccggcggccagcaacggaaccgggccgggcacggccagtgggccggcaccctcgatcgggccgccgatccgccggccggtggccgcgtcccacagccgggtgacgagaccgtcgtcctcgtcccctcgggacaccgccaggatcagccggccgtccggttgcggcagggccaccagccgatgcgggtgggcctcgtcgtgccgggtacgcagcacctggcccagcggatccccggtcagcggatcccaggagcggaccaccgcctggctgtcgtcgccgtgcagggtcagcagcaggggacggccgtccgaggttttcgccgccgtcaccgcccagatgcccggcggccacggaccggccaccggatcgccggtggccgggtcccacagtcgcagcgtgcccgccacctcctcgacgacggcgagcaggtgacggccgtccggaaccgaaaccgccgccaggcccgacccgtcgaacgggccgggcaggggcgcgccgacccgctcacccgatgccgggcgccacacctgcaccagcggaccgtcggcgtcggcgtaggcgaccgcgaggaggccgggcagcgccaccatcgccaggaccgcctccgccgggtgggtcagcggctcgccgacccgctcgccggtcgccgtgtcccacagcgacacgaccgcgggcggcccgtccccgccggcgaccgccagcagggtgcggccgtcgccgccggtgacgacggccaccacctcggcaccctccacgtcgacccggagtgccggccgcagcctgcgggccggccgctcccaggcgatcaccgcgtcgtccatgtcggccgcctccccgatgtcgagccgaccgccaggttacccagcgcccgcaccccgggccggacgccgccgcccgccggtcagcgcaacgcgcggcgtcccttgacgaccccgaggacgatcgaggcgatcagcgccacgacgccgatgatcagcagccacttcagcgctttgagcagcagtcccagcacgatcagcaccaccgcggcaacaccgagggtgacaagcagcgcacgcatggcggatctccttccgcgccggcaccccgccggatcgccagcggtgcgtacccggcgcccggcagctgtatgcaccgtcggggccgccggtccgcctgccgcgtgtggcggcccgtcgaaggggcgatcaggtacgccgctgcgatcggccgccgtcagtggcgcggatgccgaaattcccgaacgcgggcctgaccgccctgggatcaacgccttggccggccggcccaccgagcggcaatcccacggcatcggcaccgccgtcattcacaccgccgaggctttcgccgcccgccgcggtcaccgccacatcggcctcggtgtcggcgacggccgccacccgagactcctcagctacgcgacgtgacggtgctcgtcgccacgatcgccggccggaccacggcggttgaccctccagaccatcgagccgccgaatgacttgtcaccatctcaagggcgtgcgctgaactgagcagcagcaagagccgcggtcaacgcggcaccgggatcggctcttgcggccagtcggccacgatgactaaggggtttgagtccggcgatcgatattcgtcgccgggaaggtactcgatgtgctgatgccggttcacgccccggtcgtccgcggcctcggccagatgcgccacgccgtcgagcccgtcccacaagatgtcgaggtattcgcggccgccggaaacatgcaacgtggtcgcatctcgcaggccgacgagcagcgggccgccggtcacctcctgcaccacagagccgccggcgatcgctacctccagaggtgtcgcacctgactggcggagccgctggctgagggcacggagtgcggccggcgggccggcgagctccagttcgccgtcattaacggaaagacgacaaagctgatgatcacccatccgctcattctcgcttcccctaccgccagggcgggaagcacccgctcgctggttcagagaaggcactgggacaaggtgaatgcggcggaaccagccgatctagccttcgacgccgcccgtctcgtgggctccttcgatgcctggctggcagtagaagacgtccaggccgatccccggtgagttcacgaatactgacgccgaacgcgtctgaactcgcggccgcaacagcccaggggcgggcgagttcgaccttcgtcgggtgatgctcgacgatgaactcgtggagatcagcgaactgctgcagccgggtgtgaccaagccccacgtcgatcacgccgcgcgtgcttcctggctcgccgccatgcacgaggcgatgagaagcgtcggcggggccgttgtcaccgctgccgaggaaccggcggtgggccgcaactattaccgggtgggcgtggaagcccgtgacagtatcgcaggggccatcttgttcaacgcggccgcggtgttggtcgctgcggccgaggcgaccgatcctcaggagatcgctgtggtgttcgcagccgtgccaggcagcggggtgttctcggagcgaggatttcaggtggccagcccagaacagctcaatgaaccgctcagcgagcaccatctgcacgcgctcacggcggatgagcggcgtgatgtcgtctaccaccgtccgtctcgactcggagatctgctgttcaactggttcgactgacgcgtaatgccatcaggcggagcacggccgagtgggcgccttgcgatagtgccgatcgtgaacttccctctggatgagctggggccagccgtgtcggctcgggccgagaccctgggaacggctgggactcgaatggcggcttcgcccggtcgcgccgaaccacggcaagccggtgatcgtcagtgagttcgagtcggcggcctggcagggcggcctgctgatctggatcagcggcgaagcggagcttgatgccgtccgtgtctccgatgatcaagcggttagcaagcactacgacctgaccgggctggacgacctggaagtgctgctcggcgaactggacgctctgctgacctccggtcgcgttcccgatgccgccgttgtccaccagcatccgttctgccagataccggccatcgccggacaacacggcgcgatcgtgccgagaagcggacgttgaaccagcggccacgcatgcctcaccgtgtcggagaatgggctgatgtcgcacgcgcacgtccttgtccacccttcgccgctgggcgcgcgtgcgcaggatttcttgactgcgcacgcgcgggtggtgcctgttgaggcaggaccgagcgatgacgagtgccgggctgcgatgcgctcggtgcttggacacagcgacgagagcgccctgaccactttccggcgcatccagcaacgatattcggggttgacctacttcagccatttccgcggcgccgagatcgtgttcgagccctcgttcgaggtggatcgcgataccgcgcaggttcttttcgagtacgccgtcatggacgtcacgcccgacggttgtcgcagtggactcgtacggcccgacgaagcggtgtggttcggctttctgcacgtggatgtgccggcgtttccctcgcttgaccactttttggagtgtgatgccctacttcatcacgcccgccagcagcggcttttgtccgccgcgactccgctggatgccaatgcctacctgaccgccctccgcgctcgccatccaggcctacggccggtgaaatcggcaagcggattctcagtgggttggtggagcgatgacgagcgactcgtgtacgtcaacggcttcgaagcgcgactggcggctgacggacgcgccatgagccctgtgccgaccgtcgtgacgacctggctcatcgacgaaccccttcgataggggagcccgcagccactcttggcgactccgcacccgctcatgccgatgacagtgcgtggttatttcagcctgctggtgtaagaggattctgctaagcgtgagtaagaaatcttcggagttcaggctctgcctcacgccatgcactgattacctccgcgcgccgcacgattaggcgcatcctcctccctggcggtggggcccatggtggcggttcaccccacgcccgtttcgggcgggtagtgaacgcgaagaccatatcttgctcggttgtttcaagcgtgatggtcaggtggtcgaaggtatcgccaaggatcagaggcttcggtccgtgcgtgctccgccattctgcgatggcgaccaaggtctgtagatcctggatatgcggatagagggcggtggtcgtggcatcaccgagcgcgttgccacgaacgtagagttggaaaatcccgaaacggccgtcgttgctggtcggcgtgtactccgccctgaactcccagatgtctccaccgccgaccgtcgtgtcccgccgtaccgcgcgctgccagatcaagggccacggcaagctggcgcgaggaggaactggggggcgatcgcccgacgcgttccagggatatgccgaccggtcccaggagcgggctccacaatgcggacaatgcggcggcagccgagtgcgctcgcacgccgggcagcggtcagcggggacttcgcctgaccggtacgcgtcaatcaggcgggccaccactgtcaccaggggttccgtcgggtgatgctccggatctgggcagaacgcgagccattgcggccatgcataccaagcgtcatcgtctccaggtcgacgtcggcccacagccttatccttccgacgtcgcacagagaacgcctgcacttcggcgagccagagtcgtcgagcgtcctccaattcggcaacggcgcgaagaagcgagtcaggatctgactccaacgacacgggtatacccgctcggaggaccaggtggtgccaggtggcacgaaaaccgtacggggcgaaatgcagaacacattcacgtagcgcaagtaaacggtggtgcagcggcaaaccgacgttccgaactcggcccgcctgtgccgggaagctactcacgtcacgagcttctagctagctagaaggatctccaaggccgagaaaccagcgtaataccgcagctgtcgctcacgcggcccggcaggccctctcatgccgcgatccggatgtcgatgagcttctcctggtggcccggagtaggtagcggagcggcatcacgtggatggtgccgggtcggcgctgcggtgcgggagaatccgggcgcggtcggcttcgtcgcctccgcactcagccccaccgccggcgaagtcgaggcacctccgctccagccggcgcaggcgatccaccggtaggtgcgcgaacgtccgccaagagccggagccctccacctcgacgacccgcgtcgcccgccacgacttcgccgacccctgccggttcccgctgaagcctctccggaccgcgccgggctgatgaccagtcggatcccggcctcgacgacacgggcgatctcgccgcgggtcaggagggtgcggtgtggtggtaggcgaggatggcgcccgggtgctccaggttcgtcgtgggccggccgtcgcggccgagggtggttccggacgggtcggtggcgacgaagacggtgcggccgtccgggctgatcgcgacgtcccggtagcggtcgacggtgtgcagttcggcgaccgggtcgccggcgccgccgggcgggatccggtacaccgtgccgtccttgagggccggcatcagcagcgacccgcgccaggccgggatgcccggggcgtcgtagaagtccaggctcgacggtgccacggtgggccagcacatgttcgcggcgccggtgcagcgtgcgtcgcggaaatcgtagccgtcgggcacggtgccgatggtgcgcagcggatcggtgtacgccgggctggtgaagccggtctcggtgtaggtgggcaccgagggcgggatcgtgtagtcgctgtaggtcagcgaggagcacggcgccggcgccgaagcggaccagtcggcgtaccggtaggccttgtcgtcgcggcggccggcgacccgcggccaaccgtagtccccgcccgggcggatctggttgatctcgtcgtcggttttcgggccctgttcgctggagtacagccggccgtgcccgaagaccaggccctgcggattgcggtggccgtaggaccagacatgcgtgcgtacgccgccgagcaccggattgtcggccggaaccgtgccgtcccggtcgagccggagcaccttgccctggtaggcggaccggtcccgtggcccggccggcaggtcgcgagcccggttccgcaggcagaaccggtcgagctggtcgttgccctggtcgccgatcgtgtagtagagcttgtcgtcctcgcccagcacgagccgaccggcgtcgtgatccgggctggccggcagtccggtcagcaggtcggcgtggtggcgcagcgtgccggtcgaggcgtcgtaccggaaatcggagatcttgaattgctcccgcatgccggcggacgggtcggcgtcgtagctgtaggcgaggtagacgtccggcaaccgcagcgccatgccgagcaggccgtcctgcccccgcgtgcccccgaccgcttcggtgacggtgccggccaccctggtggcgccggttcccgggtcgatgcgcagcacccggtgcccgctgcgctcggtcacccagagccagccgtccggcccggtcagcacctcccaggggttccgtaggccggcggcgagcacccgcatcgcgaagccgcccgccgcgggcaccgtgggggagcaggtcagcaggacggcggtcgacgccgccagcagaagtccgcgcaccgggcgcgcatacccggatcgggacgggacaatcggctaccggcaggcgacgtggtcgccgtcggggtcgagcctctggtcgtcccgaccggccacgacaaggctggtgaagccgtgcgctgtcagccaggcgcacttcgtggcggcgtcggtgagaccgcccgggaaggtcagcgggacgcactgggtcggtgtgccgtagttgtggtcgcagccgtccacgaacgcggacaccttgaccggccccgccggcgacttccgtggggccgccgggctggctgccggcccgccggcgaagtgctggacgaagggcgcgggcctgacggccggtaccgcggccgacgccgtagccggccgctccgccggggatgccaccggcgcggggggcgagggcggcaccgctagctagctagcgacggccggagcggccgccaccaccgagggcggcaccgtcgcggcgacggccggagcggccgccaccaccgagggcggcgtgaaagccgcgcggccgagcgtcaccaggaccgccgcggcggccgccgtcccgacggccaccgagagccaggtgatcctcatccgacgtgcacccactgcgccaccgacggcaccccgttcgtccccaccacgaacagcatgtaccagccgggcggcgcgatgttcgggttcgacgtcaggttcagcccgatcgtggtcccgttcaccgacatcggcaggtcgacgaaccgctggttcgggtcgctggagtgcgtcacggcctcgggccggatcagttccgccttcaggatcgggccgtccaccgtgatcgtgtggctggacccgtatgcccaccggttgtcgggcatggccaggatctgcggccgcgccccgcggaacagatacggcggcgagtagaccgacagccgcatgtcgaacgtcccgtcccccgggttgtcgcccaccgccatcacccggccgtccggcagcaggaacgccgacgagtgatacgtgcgtggcaccgggtcggtcgccatgccggcggtgaacgtggcggtggccgggtcgtacatcgaggcctcgtagaccggatcggcccggttgtgcaggcctccgccggtctcgaacaccttcccgtccggcagcagcaccgccgacacgtacatctttgcggccggcagtgcgggccccgccgcgtacaccggattcgcctgtttcagatcgatgatgtcggtgagccggttggcgtccacattggtgttgatgttgccgccgcccagggtgagcaccttctggtcctgcgcgggcggcagcagcacactcgtcgactggtcgcgctcgtccttgttccgcagcccactcaccgcagtgatggtgttcgcgccgtagtcgtagatcgacgccccggtgcccggcaacccgttcccgaagacgtgactgccggtgtagaagagccgcccgtcctgcagcaggatcatcgacgggtacagcccccagaaggcccacgtctggtgcgcctcgcccagacccagccaccgctgctgggcattcgagaagtactgcgtcgccaccgtgccggacgagtcctccccgaggccgcccagcgagatgacatccccgttgcccaggacggtcgccgacggataccaggatcccgcggtcatgtcgtcgacccgggtgtagctgtcggtggccgggtcgaagacgtacgagctccgcagaccctcgtacccgtggctgccgtcggccgccggataggccttgttcccgcccatgatcaacacccgtccgtcgggcagctgcacatgccccgagcagaacaggtcggccggggtcgccacgctgctgaacgtgccgctcgccgggtggtagaccgcggttgtgaaggtcttcgccgcgaagtcgtccgggttgttccccgacccggcgaccagcagtacgtccccgttgcgcagcaccaccgagtggatgccccggaccggcgagtcgaacggcgacacctgccacacgcccttggtgcaggcgtccccggcactgcacgaggtgccggtcgccggcgcggtcacgtcgttcatcgcgtagtcgtcggtctgcagtgtgccgacgccgtagatggtcacgccccagacgatctggtcggtgttcgcgggcacctgcggcgtgcgcacggtcttccgcgtccaggccgaggccaccggcagcgtcgccagatcggtccagtacacccacccctgcgccaagtcgtgccggaacacggtcatcacggtgttcgcggtgctcgtcgtgtaccaggcggacaggtcgtactggtgtcccggcgtgacggtcggcgcgcacgacgggttctccagcatcatcgccttgcggtccccgctgggcgaggtggcgaggctgatccgcatggcggtggcgccggtgtggccggggctgctcaccccgaaggtgaagctctgatcaccccagccggacttctcccagcacaccgggaagccggccgggtcgaggttctccaggccggggttggcgaccaggttggcgctcgcccgcgccggccctgccgggaccgtagcggcgagcaccgcgaggagggcgacgacgagcgcttggccgatgcgcttgcggtccgtcccgctcaaccacggcctggggtacgacctgagcaccgtcacgccggcaccggccggagggtgcgcgcccgatagatcaccttgtccgagatgaggaaccgggccgcgaacgacaccaccagcgtgaccaggttcgccggcaggacgccgagatgcgccccgtcgaccagtagcgccagcagcgggatgcgcagcagcaggtcggcgttgccgagcaggaagaaccggctgagccggctccggaggctgcggtgcgcccgccgggagcggtagagcagcgtgtcggtcagcgcgaagttccacccgaccgcgaccaggttggcgagtacggccgcggccaggtagtgcaccccggccaggtggttcagcgcccacagcgcggcctggttgggcagcagcccggagaggccgatcagcgcgaagatcagcagccgggagcgctgggcgccgaaccgcagcagcccgaggtgccggaggaagcgcagcccctcggcgatcgacgacttggactcgccggcgtgccgcggctggaaggagtacggcacctcgacgatccggccgggccggttgcggaccaccagctccagcaggatcttgtagccgagcggccgcagctcgcccacctccagggagctggtgcggattgcgaacaggccgctcatcgggtcgctgacctgcagcagcgcagtgcggaacagtagcttggtgacgaccgtcgagccgccggagacgagccgccggtatccgccggccagcccgtcgcggttgccgccgcccgcgtaccggctgccgacgaccaggtcggcgccgtcccggacgcccgccgcgaccaggccgggcacgatctccggcgggtgctgcaggtcggcgtccatcaccacgatccattcgccgcgggcccgtcgcatgccctcgacgaccgcgccgccgaggccgccggcaccgtcctcccggtggtgcacggtcaccgggatcgggcaggtcttcgccgcctcccggatcacctcgggggtgtcgtcggtgctgtcgtcgacgaagacgatctcggtctggtcggcgggcagcgctgcggtgaggcgggcgagcagggtggcgatgttgtcccgctcgttgaaggtcggcaccacgacggtctgccgcagcgcggtccgcaccaccggctccccgatggtcccgcgcatcgtcgcgcgcgccctcccgggctgcgccgtctcggtgtgaacggtgagggtcatgacgttgcctccttggccacacggcggatctcgatcaggccgtccggcgggccgaacgaggcgatcacggtcgagttcgtcagcagggtccggatggtgggcaggctgttcgggtcctgccggatggccggtgtcgagacgatgtagtcgacgtcgcgccacccgccgggcagccgctcggcgaccgccgagtcgaggtccaccttgtagaaccagagcaccctgtccggcgggtaaccggcgtcgacacagtcgagccagagcacgtcgtcgaccacgatcgtcccgccctgcgagccggccagccgctcgtggagatagccggcgacctgcgcgtacggcgcgttgtcggtcgtggtcagcgcccggtggtctccgacgtaccagcgggggaccaccaccgtgagtgacagcgccaccgcggtgccgaggatcgcccaccgccaccgggtgcgtccggggcgcagcgtggcgacggcccaggcgatcaccccggcgatcgcgatcgcgaagaacggcatcacctgcaccacgtacatggccggcaggtagccgcccggccgcagcgcgaccagcaccaggatcgtcccggccagcgcggccggccggacccgccgcagcgcgagcccggcgaaggcggccaccgccccggcgatcagcagcaccgagtcgtagtagagccacgagtgcagcagcgacgacgcccccgagccggccgagaagacgctgcccgagccggcccgggagcccagctggaactcccaggcgccgatcagcgacacgtgccccgggccggggaacagttcgccgcgcagcaccgcgtacagcgggtagaagcagccgatgaggacgaggccgctgaggaaggcgccgaacgcccacggccgggtggagctgcgcgccgcgttctgccacagtgccacgaccacggccggcaggacgacggcgatcgtctccttcgacagcacggcgaccgcggccgcgccgccggccgccgcgaagtgccacaggtgcctgcgcggggacagcgccagggccagcgcgccgagcatccacaccacggcgaacgcgtccaggtagatctgccgtcccatggtcaggtacagcggcgacaggccgtaggtgaccagcgccagcgcggccgcccagcgcggcagcccgatccggcggctgaccaggtgaaccaggagcagcccggcggcctgcaccggcagcatcgcgatccgtccggcggcgaccgcggtcagcgccgggaagagcagtttcgggagccaggcgagcccggccagctggacccaggccagcggcggatggtcgtaccagtaggtgtagtgcgccagaccccggccgtgctgcaccgcccaggcctgcgccaggtaggtgccctcgtcgtcgctggccgccgggaaaccggtgatgttccaggtcagcagagcgacgatcaccgcggtcagaccgagggccacggccaggtccgctcgtccctcgcgatgtcgcggcggtacgtcactgcccgctgccgggacgaccggggcgggccgggccaggtcgatcgtggtcatgccgccgccgcctcggtcaggtgcgcgccgacgtgggaggtgagttcccagttgcggcggccggtgtattcgcgccagacggctcgcagcgccgccacggccagcacgatggcgtacgggaaagcgccgatgatcaggcgggcgtagtggtgccaacggatccgcaagtcgtactccttgccgaagtcgcgcagcccgatcacctggaacatcagggtggccaccatcggcagcacgggcaggaaggtgaccagggcgaccagcacgggcagctgcgcccagagtgcgatcgccaccccgatcgggatcaccacgccggcgaaggcctgcacgaacgggctggtcagcgtgtagcgggcgaggatccgctggcgcagcgtgggcagccgccgccactcgcccttgcgcagcacctgcaggaagccctggtgccaccgggtgcgctgcttgagcaggccgggcagcgagtgcggggtctcctcgcgggtgacgatcgtggagtcgtaggcgaccaccaccttggccccgcggctcgacaggcgcaccccgaggtcgcagtcctcggccaggcaggtgccgtcccagccgttcgcgccgcgtagcacgtcggtgcgcacgaacacggtgttgccgccgagcgggatgaaacccttcttggcgtgcaggtgcagccggctgcggaaccagaagaaatactccaggcagttgtgcaggctgtaccagctggaatggaaattgatcagctgaacaccgccctgaaccacgtcggcgccggtcgcccggaatgcgtggtcgacgtgttccagcaggtcgggatgcacctgatcctcggcgtcgaaaacaccgaccacgtcaccccgcgcataggccagcgcggtgttcagtgcccgtggtttgttcttcacctcgttgtggtcggtgaccaccaggatccggcccggcgcccccgccgcgacccggtgggccaccgcggcggtctccgggtcgtcgtgcccgacgatcacgatgatctcgaacgcctcgtgggtggaccgcagcaaccgctgcacggtgtgctccagtacggcctgctcgtgccgggccgggacgagcagggagaacgtcagatgctgttcgccgtccggcggtgcgaaccgggtggcggccagggtctccggcgtacgccaggcgtgcatcgtccaccacagggtgaccacggcgaacgccgagaggaccaccgagacgaaaaccatgacggcggcagccaatgtcttgtgcctttccgaaatcggcgggcctcgctcccgccgttcgaggcagagtcaactgcgtgacgtcgatgctgttcaaggctcatgtcgactattttgcaatgcgccgggaagggttttcgcggccgaaacacaggcgcaacgccaactccgacatgccggaaatggccgcccgatccgctgccggggaatgggttgccggaatgttgcgcgcgaatatcccgattagtgtgaccgggctcattgcgacggcgcgtgacgccatttataacagtagaaatcaatcgttctcgatgaggcgcagggcggccgcggcgatggcgtcctgcagttggtcgtgcggcggcagcacggccagatcgcggcgcatcccgatcacgctctccaccaggccgaggatcaggtcgccggggatgacgccgccggccagctcgcggtaggtgacgcggagctgctcccggccggcccggaagtgcgcgaacggctcggtggcgatttccggcagcgcgtacaggataccgatgttccagcgggcgccgagcagcaccccgacgtcgtagcggaccagggcgcgcaacgtgtcggcggggcccaggccctgcgccgacagggcggccgcgtagtcgaccgacggccggaccgtggcctccagcatctcggcgaggatctgctccttggtccggaagtggtagtacagcgacgcctgccggacgcccacccgctcggcgatcatccgggtcgaggtggccgcgtacccgcgctcggcgaacagcgcggcggcggcgtccacgatctcctcgcgggcggagccgccgaggcgtcgcgcgccgctggaccgggggcggccgaccggggcggcggggtgcggagaactcaccccggcatcgtgtcacgcgccgtttcgcaccggccgcaccggagcgatgtaacgctgccgacacatccggcaactcaacgtttacgaccgggaaaccgcccgcggcccgcggtcgccgaacctgtcaatcgacaggtattcggcggcgggcgagcggcgcccggccgccgcctgctccccgggaggcggttatgaccaccaccaccagcaccgacgccgcggacctgcgcggcttcggctacgagcccgaacttcgccgcagcatcggcagctacgcctcgttcgccgccggcttctccttcgtctcgatcctgaccacggtcttccagctgttcgccttcggcttctcgttcggcggcccggcgttcttctggacctggccgctggtcttcctgggccagttcacggtggcgctcaacttcgccgagctggccgcccggtacccgctgtccggttgcatctaccagtggtcgcggcggctcgccggggccacggtcggctggttcgccggctgggtcatgatcatcgcgcagatcgtcacggtggcctcggccgcgatcgccctgcaggtggtgctgccgcagatctggtccggcttccagctggtcggtggcgacccgtcgctcacctcgaccaccggcgcgaccaacgcggtcatcctcggcgcgatcctgatcgcgctgaccaccctggtgaacgtgatcggcgtccggctgatgtcgatcatcaacagcaccggcgtcaccctggagatcatcggcgtcgccgcggtggtggtgctgttgctcgtgcacgccgagcgcggccccggcgtggtcctgcacaccggcggcctgggcagcggactgtcctatgtcggcccgttcctggtgtcggcactgatggcggcgtacgtggtggtcggcttcgacagcgccggggagctcagcgaggagacccacgacccgcggcacaccgcgccccggaccatcctgcgggccctcgccgcggccgggatcggcggcggactcctgctgctggtggcactgatggccgcccccagcctgaccgacggccggctcgccaccgagggcctgccctacgtgctgaccagccgcctcggcgagaccggcggccggatcctgctgatcgacgtggccatcgcggtcgcggtctgcaccctggcgatccagaccgcgggcagccgcatgatcttctcgatggcccgcgacgaggtgctgccgttctccgccgcgctcagcagggtgaacccgcggaccggcaccccggcgctgccggccatcgtggtcggcgtcggcgcggccgcgctgctgctggtcaacatcggacaggccgccctgttcaccgccctgaccagcgtctgcatcgtgctgctctacctcgcctacgccctggtcacgatcccgctgctggtccgccggatcaagggctggccggtgaccgggccggacgtcaccaccaccgagcgcggcggccggctgttctcgctcgggcggaccggcatcgtggtcaacggggtcgccgtcgtctacggcctcggcatgatcctcaacctgggctggccgcgcgcggaggtctacgacccggccggcgcccactggtacctgcactacttctcgctgctgttcgtcgccgccacgctgatcggcggggccctcgcctacgcccgctaccggacccgggcgatgtcgctgcacctgccgtcgttcccggccgtcgtcgccgagggggaccccgcatgagtaccgccaccacggccggcgcccggcagcacgcgcgggcgcaggccgggaccgtcaccgaacacatgccgatcgtgccggccagccgggccggggcgggcctggtctgggccgagaccgtcccgggcggcggttacgcgagcaagcggctggcccgcggcaccacgctgcggctgaccgccccgcacggcgacgcctgcgtctcggtgctgctgttcaacgccgacgaaccgtgggaacgcctcaacgtcgccgacaccgtcaaggtcctctggcaggcgtacgtcggcgaggggcacctgctcctgtccgaccagggccgggtgctcgcctcggtcacggcgggcgccgcggatctctcggacaccttctgcgggacgacgacgatcacgagcaacatccggcggtacggcgacggcagcgcccactcgggcacccccgccgggcgtgagctgttcaccctcgccgccgcgaagcacgggctgacccgccgggacctgccgccgagcatctcgttcttccagggggtccgggtcggcgacgacggccggttcgccccgcccgcggcggccgggccgggtgccaccgtggagctgcgtgccgagatgccgctcaccgtgctcctggtgaacgtgccgcacccactcgatgagcggacgacgtacacctgcaatgccgtcgaggtcagagccgcgaccggggccgcgaccgcgcccaccgaccgcctgtggtctcgcagcccggagggcgagcgggccttcctgaacaccgccgactacctcaccgcgcgggggatcgcatgacgaccgttctcgaccagatcgtcccggcgcgcgcgccgtggtcggcgatcgtgcgccacgaccagaccttgaccatcgtggacctgcacggcaaccaggccgtcgactgcctgatctacaacgccgccgacaccgccgagcggtactcggcgccggacaccgtcgcggcgcagggcgggatcttcctgaccaccggcagtgtgctgcgctccagcgaggggaacccgctgatgacggtgatcgccgacgaggtggggcggcacgacacggtcggcggggcgtgcagccgggagagcaacacgctgcgctacggccaccacacccagcatcagcacgcctgcgtggagaacttcctgatcgagggcagccggtgggggctcggcaaacgcgatctggtcagcaacatcaactggtacatgaacgtaccggtcgacccggacggcagcctcggcatcgtcgacggcctctccgcccccgggctgaccgtcacgctgcgcgccgagctggacgtgctggtgctggtctccaactgtccgcagatcaacaacccgtgcaacggcttcgacccgacgccggtccgcatgatcatctcggagggctgaccggtgttcgacaccctgctcgtggccaaccggggtgagatcgcctgccggatcatccggaccgccgcccggctcggcctcaagacggtcgccgtgttctccgagccggaccgggccgcgccgcatgtgcggatggccgatcaggccgtgctgctcggaccggcgccggcccgggagagctacctggtggtcgaccgggtcctggcggcggcgctgtcgaccggggcgggcgccgtgcaccccggatacgggttcctgtccgaggacgccgcgttcgccaccgcggtggaggcggccgggctcgcgttcgtcgggccgacacccgcccagctgaccgcgttcggcgccaagcacaccgcccgtcagctggcgagcgcggccggcgtgccgatgatccagggcaccgggctgctgtccggtctggacgaggcgctcaccgccgccgcggcgatcggctacccggtcatgctgaaggcgaccggcggcggtggcggcatcggcatgcaggcgtgcttcggcccggaccagctcgcccgggcctacgaccgggtggaacgcctggcggtcgccaacttcggcagcggcggcgtgttcctggaacgcttcgtgccgcgggcccggcacgtcgaggtgcaggtcttcggcgacggcgccggccgcgtggtggcgctcggcgaccgggactgcagcctgcagcggcgtcatcagaaggtggtcgaggaggcgcccgcgcccggcctgccggcggcggtccgcgaccggctgcacgagtcggcggccgcgctgtgcgcgtcggtgggctaccggtcggccggcaccgtcgagttcgtctacgacgcggcccgggaggaagcctcgttcctggaggtgaacacccggctgcaggtggagcacccggtcaccgaggagatcttcgggatcgacctggtcgcctggatgctgcgcctggcccggggcgacgcgggcatgctcgacgagccgcggcgggcggccggggtggcggtggaggcccgcgtctacgccgaggaccccacccaggaccaccggcccggcgcgggactgatcaccgacgccgtcttccccggcgacgtgcgggtggacggctgggtggccgccgggaccgaggtgggcaccgcctacgacccgatgctggccaaggtgatcgtcaccggagcgaccaggggcgaggcgttcgccaacctgcgtaccgccctggccggaacccggatcgacgggatcgagacgaacctggggctgttgcgcgcggccgccgcgcacgaggacgtgctggcggcgcgacactcgacggcgaccctggccggagtgcacgacaccgagccgcgggtcgtggtgcagcggcccgggacgctgacgacggtgcaggactggcccgggcgcatcgggctgtgggaggtcggggtgccgccgtccgggccgatggacgacctgtcgttccggctgggcaacagggcgctcggcaatccggagggggcgcccggcctggagtgcacggtggacgggccggcgctgcggttcaccgccgagaccacggtctgcgtgaccggggcaccggtgccggtgagcgtggacgggcggccggtgccgcagtgggagccggtggtggtgccggccggtgcggtgctcgacgtggggacggcgaccgagggagggttgcgggcgtacgtgctgttcgccgggggcctggacgtgccgcggtacctggggagcgcggcgacgttcacgctcgggcagttcggcgggcatggcgggcgggcgttgcgggtcggcgacgtgttgcgctcggctgtcggcgcgatcggggccggccggcccgtcgccgcgcccccgcacatcggtcatgactggcggatcagggtgaccgaggggccgcatgccgccccggagttcttcacccgtgaggacatcgacgccttctacgccgccgagtggcaggtacacttcaactccgcccgcaccggcgtgcggctggtcggaccgaagccccgctgggcccgcaccgacggcggcgaggccggactgcacccctccaacatccacgacaccccgtactcggtcggcgccgtcgacttcaccggcgacgtgccgatcctgctcggcccggacggtccgagcctgggcggcttcgtgtgcccggccacggtgatcacctcggagcggtggaagctggggcagctcagcccgagggacacggttcgtttcgtacccgtcgacgaccttgatttcacgcccttgatcaggactcgggacgacggcgtcctggcgaggaccgacgacgccacctaccggcgttccggcgacgacaacctgctcgtcgaatacggcccgatgaccctcgacctcggcctgcggatgcgcgggcacgcgctgatggaccggctgcgcgccgaaggcctgccgggcgtcgtcgacctcaccccgggcatccgctcgctgcagatccacatcgacccggcggtgctgccggtccgcaagctgctcgacgtggtccggtcgatcgagctgcccgcggtccgcgatctcgaggtgcccagccgcaccgtgcacctgccgctgtcctgggacgacccggcgacccgggaggcgatcgcccgctacatgaacggggtccgcgacgacgcgccctggtgcccgtggaacatcgagttcatccgccgggtcaacggcctcgacgcggtcgaggatgtctaccggacggtgtacgacgccagctacctcgtgctcggcctcggcgacgtgtacctcggcgcgccggtcgccaccccgctcgacccgcggcaccgcctggtcaccaccaagtacaacccggcgcgcacctggacgccggagaacgcggtcgggatcggcggggcgtacctgtgcatctacggcatggagggtccgggcggctaccagttcgtcgggcgcaccgtgcaggtctggtcccgctggcagcgcgaggccggcgacccgtggctgctgcgccacttcgaccggatccggtggtacccggtcggcgcggaggaactgctcgacctgcgggccgacatggccgccgggcggcaccggctgcgcatcgacgacggcaccttccggctcgccgaccacgaggacttcctcgccgcgaacgcggactcgatcgcggcgttccgggccacccaggcggccgcgttcggcgccgaacgcgacgcgtgggcggcggccggtgaattcgacccgcggcccgaacccgaagcggcgcccgccgccgggcaggtgaccgtgccggacggcggcgcgctcgtcgaggcgccgttcgtgtccagcgtgtggcgggtcgacgtgcggcccggcgaccgggtggccgcggggcagccgctgctcgcgctggaggccatgaagctggaaaccgtcgtcaccgcgccgcgcgccgcgacggtcaccgacatcctcgtcaccccgggtgcgcaggtcgcgccgggcagtccgctggtggtgctggcatgagaccgacgacccgggtacgcgccgcgtacgaccgccttgcccgcaacgagcggccggaagcgtggatcacgctgcggccggtgacggacctgctcgccgacgcggtcgtggtggaggcgcgactcgccgccggagaggaactgccgctggccgggaagctcgtcgcggtcaaggacaacatcgacgtggcggggctgccgaccacggccggctgcccggcgtacgcctaccggccggcggtcagcgccacggccgtgcaacggctggtggacgccggggcactgatcctcggcaagaccaatctggaccagttcgccaccgggctggtcgggacccgcagcccgtacggggcggtccgcgacgtgcgtgacccgacccgcgtctccggcggctccagctcgggatccgcggtggtcgtcgcgctcggcatcgccgacctggcgctcggcaccgacaccgcggggtcggggcgggtgccggccgcgttccagggcatcgtcgggatgaaacccacaccgggcctggtgccgaccgacggggtggtgcccgcctgccgcagcttcgactgcgtgaccgttttcgcccgcaccctcggggaggggcgtcaggcgctcggcatcatcagcgacccgatgccgccctcgggcgcagcgccgccgcatccgatcgtcgcggtgcccgaccgctgcgagctgaccgcgctgtcaccggaccggctcgatgcgttcgagcaggtcaccaaggatctcgaagccgccggtgcccggctgcggccgatccggctcgccccgttcctggccgcggcgaagctgctctaccagggcggcttcgtcgcggaacgctacgccgccgtcggcgcgttcatcgacgagcatcccgccgaggtcgacccgacggtgcgcgccatcatcggcgccgcccgcgacatccccgcccacgtgctggtcgccgacaccgaacgcctcgaccggctgcgtgccgaggcgatggccgagtggggcgacgccgacgcgctgctgctgccgaccgcgccgacgcacccgacgagcgccgaggtcgccgccgacccgatcggcgtcaacgccacgctcggcacctacaccaacttctgcaacctgttcggcctcagcgcggtcgccgttccggccgccttcggcgtccagatcatcgcccggggattcgccgacacggtcgccgccgacgtcgcggccctcgtcctcggcgaaacaccctgcggcggtacgaccggaaccgggctgccgttgctcgtggtcggcgcccacctgaccggtcagccactgaaccaccagctcaccgagccgggcggccgcttcctgcgggccgtccgcaccgcggcgcactaccggctgcacgccctgcccaccgacccgcccaagcccgggctggtccgggtggccgcgggcggcgcggcgatcgagggggaggtgtgggcgctgccgccggacgcgctcggccgattgctggccgggctgccgagcccgatggcgctcggtccggtgcggctggcggacggcacgacggtcaccggcttcctgtgcgagggtgtcgccgccgaaggtgccccggacatcaccgggcacggcggatggcgcgcctacctgtcgtcccgggcgggatcgtgatgcggcgcatcggtctgcgggcgccccgctatgtgctcggcgacctgctgctcaccctgctgggccgggcctggcgacggatccggcggagaaggcgccgctgaccgcccgacccgcgtggggcggccgagccggctcaccgtcccggcgcaccgcgctcaccacggccgccggcagaaggtacgccggtccggctcagcctgcgcagccggcgcgctccttgtctcctcgccggctacgccgggtcggctgacgtgctccggaatgcctcggtgaccaggcggaggtcgcttgatgtcagctcggcgtcggcgctgcggtaggcgtgcgatccgaggcacaccaaggcttggtcaacgatggtccatccgcagtcgcgcgtccagaagcgagggctgtcgagcaactcttcggcgacggcgtgggtaccggacacggcgccgacagcggtgagggcggccgccaccatctcggtcacgtcgctggggcggtcgcgatctgcgcaggccggcaggagaagcagcagtcgttcagcggacgtgtgaggggcgccggggggtcgcgcggtgtcgatcagctccggccaggcgagtgccggccctcggaagtgtccgtccagcgcagcgagcggaatcgacctgctcccggtgccggggtcgagaacgtagtcgacaccgccgtcgtcgggaaggttccgcatcacgacgtgcagctgaccggtgccggcgagcagcagcgagaacaccggccactcgtgctcgtccaggaaagcgtcgaccatctcgtcgaggtcggcaggatcagcgccgaaagcgtacggcgccgttgcagatccgcccacggtggacaggaacgccggccagaacaggtcgtgcgccatcagcgcggagccgtcgaccaggggcgagtcgacgatcggcggttcgtacccgtccagatatcccgggatcatcaccccgtcatgctcgcagcaacccggcgccgactacaaccggtgacgtacacccggtgcccggcgcacacggacggcggcagatccggtcgtcgtgccgatcgcggcggctgtggggccagccgttatccccctttgacaaggcggtcgtggaatcttcatgcgcgcgagtcatgggccggcactctggcggcgaaaaccgattgcgtggtctctgcggtgtggttgggtcgacgcatgtcgatcacgatgcagcttgcgacgccggattcgttaggcgagatcgttgaggcggtagcggtctggcagcacaccggcgggcccgtgcagcttcatccaggcgacctcgggtggcactggaggttcggcgggcgggagttggccgaggccgtccgggtgtggacccgtaacgggcagatcctggccgttggcctggtggacgacggggtgatccgcatgggcatcgcaccgggcgtcgacgaggacgccgcgttcgccgcccggctgctggccgatctgtcggatccggggcacggggtactgcccgacggcgccggggccgtcgaggcccgtttcggcgctgctcttcgacacctcctccgtcgcagcggttgggtgcccgacgaaccgtggaccccgttgtctcgcgaactgatcgagccggtggaggactgcgggctcagggtcgaggtcatcgaggcgcacaacgttcgggatcggttcgtcgatgatcgggtcgcggtgcaccgggcggcgttcgccaactcgacgttcactgtggagcgctggcgcgcgatggccgctgccccgccctaccgtcgggcccggtgcctggtcggttacgacggcgacggcgatgcggtcgccgcggcgacggtctggtcggccgggggcgggcgaccgggtctgctcgaaccaatgggcgttcatcgggatcaccgtggccacgggtacggccgcgccatcacggtggccgcggccgccgcgttgcaggagatggggtcgtccagcgcgatggtgtgcaccccgagcagcaacgtcggcggcgtggcgacgtacgtctcggccggctttcagaaggtcccggacgttaccgacttccgccgcacgagttgactgaacgacgaactcgaaacactcaatacgatctctgtgtattcgcgcgcggctgggtgacggtattggtcgtacgatcaggggcacacgaagtggctgatcgtccttgccgtgaattctgaatctggcgtgcgtggcacattcagcgttgtcttgcgaagccgccggcgggccggcacgctgttggtccggcggcggtttgtcgtagcggttcaccacctgatcagcggaaatggggagactccggtggcgctttcctccgtgcttgatccgaccgctcgacgtggcgcggctcgtacggcacggcgggcgctgccgagtcgccatgcccggcagcgcccgcggatgctcgaagacttatcagtgcgtgcgcgggtcgacgtcgctgctgcggctaccggccttggccaggccgcggctgatcatgtagccgatggtcagcagcgtgatgtaccaccacgctttgtcagcggcgaaatggtcggtgccgttgttggcggccccgtcgccgacggtgtaagaggcgatcagtacgccgatgactgcgagcacataaacaatcagctcagtggtcttgaaggagggcttggtctcctcgccccggaaccggtttcccttcacggcgacgttctcgtgtgcgtgggtgctggtagccataatcaactcctgaaattcacgtttaagccgtcggaaaactggcgtgaccactgactacccggccggtgaggtgacaatcggcaaacgcacgggtgtttccaacccgttaccaagacaagggctcgcggtcgcgggaaaataacgcaccggtaacggcacgtcgtggtgcggtcgccagcagaggaggacgacggtgggtcctgatgagaacacctatgtccgggatcagaacgcccgtgtggatccgatgctcaccatcggcacgatcaccgccgcggggctgcgggacattctcgccgacctgcccgacgacgccgtggtggtcgtcgcgagggatggagcgggcgacgacacctgttcaccgttggccgatgtggaggagtgctggtacctcgcggcgtccggtgagtccgttcccctcgggcgtgacggcgacggcaatgtccacgagcccggccccggcgacctgtacgccgtcctgctgcgccccacctgctgactccgagcagcggcgaacctgccccgggctgtacggcacgaagtgcggcaggagggacgccggctgcgagacgcagcccgacgcacggtgccggtcagctctcgtcgagggcggcgtgcatgcgggtcagcagggtgccgagcagcgcccgctcgtcgtcgctgaaggccgcgagggcccggtgggtcgccgccatctcggcgcgcaccattccgaccacctcctcgcccgccggcgtccgcccgatgatcttgatgcggcggtcggtgggggcgacgtcgcggcggaccaggccgcggcgctccagccggtcgacgaggccggtgacgttggaggcgtcgcaggacagctgcttggccagcgcccgcatggactgcggccggtgcaccaggatcagcagcttgacctgcgtggagttgaggtcgtgccggtcggccacggcggcgaactcctggtagtacgtgctgctggccagcacgaaccgctcgatgagctgggtcgtcgaggggctgtccggctccggtgggtggcgcacggcaccagcgtaccgagaagcttgactttttcaacagttgccatttacggtcccattcacttgaaaaaatcaagcttttagcaaatcaagctttgtgaaggacacccgacgatgtcttcccccgccgcgcgccgcgagaccgtgctggtgctggtcctcggtgtcgccaccatggtggtgtcgatgatgcagaccctggtcgtgccgatcctcggcctgatcgggcacgacctgcacgccagcacctccgaggtcagctgggtcaccacggccacgctgctgtccgccgccgtcttcaccccgctgctcggccggctcggcgaccagtacggcaagaagcccaccctgctcgccgtcctggtggtgatggtcgccggctccgtgctggccgccctgacccactcgctgggctggctgatcgtcgcccgggtgctgcagggcgcggccaccgccatcttcccgctggccctgtccgtcgtccgggagcacctgcgcccggaacggctgcccggcgcgatggccctgatcagcggcaccctcgcgttcggcggcggcctggcactggtcaccaccggcctgctcacccagggcgcggacgccgacttccaccgggtgttctggctctccgccggcctcgccgtgctcgccctgctcgccgtcgccgcgatcgtgccgtccggcgggcaccgcagcggcggccgggtcgacgtgtggggcgcgctcagcctggccggcgtcctggtggcgctgctcctgccgatctcccagggccacggctggggctgggccagcgcccgcacgctgggctgtttcgccgccgcggcggtcctcgccgtcgtctgggtgctgatcgagcggagcgtcgccgagccgctcgtcgacctgcggatgttcacgcaccggccggtgttcttcaccaacctggccggcatcctggtcgggttcggcatgttcacccagtcgatcggcatctcgtatctggtgcagatgcccaccgcgctggccggctacggcttcggcgcctcggtgctgcgcgcgtcggtggaatacctgctcccggccgcggtcgcctcgctgctcgccgcccagctcggcggcgtcctgctgcgccggatcggcgcccgcgccaccctggtcgccggcgccgccctcggcgcgggcggcttcgcctggctggcggtcacccacacccggccggcctcggtgatcgccgccggcgcggtgatcggcgccggcgtcgccctgggctacgctgccatgcccgcgctgatcatggccagcgtcccgcaccaccagtccggcatcgcgaacggcatcaactccatctcccgctccaccggcagcgcgatcggcagcgccacggtcacctccctgctggccgccgccagcgtgcccggcctgccgccgggtgtgccgccgctgcccgccgaaagccagttcacgctcagcttcgtcctggccggtgccgccttcgccgtcctgatcgtgatcaccctgaccggcctgcgccgccacccgcagaccccggccaccccggccgcccccgccatcccggcgaccgaccccatccaccccgatccggcgccggtggcggccgcgcgctgatcaggcgttccgacgatccggcgccggtggcggctgtgcgctgatcaggcgttcccatcatccggcgccggtggcggccgcgcgccggccgtcgggctgtcgggctgtcgggctgtcgggaaacggtgacgacctacgatggcgccgtgcccagcgagcgtgagatcttctggcggccgatgcgcgatccggggccgcgacctcccgacggcgcgatgccggccggtggccgtgagcagctgcggtatgtcgcgcggcggcgagccgccgagctctggcgacatccggaacccggggcgctctggtcggtggcggcctcgtcgcggatgtgggagcggcgggtcaccgacgacgacttcgccgaggtccggatcgggaccaccgcggtgcgcacggacgggtcgtacgggtcgctgggcgccaccgcggtggcgcagctgccggtgcggctgcggctgacggatttcccgcgggtggtgctgcacggtgatcgggaccacaccaccgcgctgatccgggcggtgctggcgcagctggcggtactgcacgcgccggacgagctcggcatcacggtggtcgccgcggcgccgcggcaggttgactgggcgtgggtggcgcagctgccgcacgccgatgccgacggtgcgccggcgcaccgggtgctggtgctggacggggtggagccgccgccggtggaggggcccggcacggtcctcgacatcgacgggcgactgccgggggacgggatccacctgaccgtctcggcgggcgccgtgtcggtgatcggccgggagcacgagggcccggtggcggtcccggacgggatggacgaggtccacgcggcggggctggccgcgttcctggccggatatcaggcgccggctcaggcgtggcagccgaacgagaccctcgcgcacctggtggggctcgcggacccggcccggccggggccgcggcgggagccgggcgggctgcggatcccgatcgggcggacgccggacgcctcgatcgtggagctcgacctcggcgagcacccgcacggcctgctggtcggtgcgacgggctccggcaagagcgaattgttgcgtacgatcgtcgccgccctcgccgtgacccacgcgccggacgagctcaccttcgcggccgtcgagtaccggggtggtgcgaccttccgggagctggacaggttgccgcacgcggccggcgtcatcagcaacgtggagttctccgaggactggcgcacgccggaacggatgcaggccgccctcgtcggcgagctcgaccggcgacggcggctgctgcgggcggcggggccgttcgcctcccgcggggagtatgcggccgcccgggccggcggcgcgcccctcgccccgctccccgcgctgctcatcctcgtcgacgagttcaacggcctcctcttggaccggccggatgtcgccgacctgttcctgcggatcgtccgggtgggccgcgacctcggcgtccacctgctgctggccacgcaacgcctggaggaggggctgctgcgcgggctggagagtcacctgagctaccggatcgcactgcgcaccttctcgtcccgggaaagccggcaggtgctgggcgttccggacgcctacgagctgccccgccatcccgggcacggctacctgcgggcgggcgccgagccgacggtgcggttccacgcggcgcacagctgcggctgggctcggcttcccgacctggacgagctcggcgacccgaccggtgtcgaggagcacgaccgccggagcgacctcgagaaactggtcgacgcgctggcgggcgaggagccccgcgcacaccggatgtggctgccggtgccgccggagtcaccgtgcctcaccgggttgctcgccggggccggaggcgatcgactgcgcgtgccggtcggcatcgtcgacgaaccgtacgagcaccggtacggccccttgctgctggacgtggccggcaacgtcgcgatcgtgggagacacccgctccggcaagagcaccctggtgcacacgctgacgaccgcgctcgccctccggcacagccccgccgacctgcagttcttccacctcaacccgggcgcggagccactgccgcaccggtcggccgcggccggctggggcgacacccacggggtgcggcggatcgtcggggaactccggcgcctcctggagaatcgtgcggcgggcgagacgtgggacgacccgtaccagacgattgttgtgatcgtcgatggctggaacgggttgcgcaacagccccccggggtctggaggccgccgtcgtcgagctggtccgccgcggcccggagcaccgcatccacgtggtgctgaccgccgaccgctgggcggatctcagcgccgggctgccggagtccgtcggcacccggctggagctgcggttgcgcgacgccgagcggtcgatggtcagccgtcgtgccgcgctggccgtgccgcgccgcgatcccgggtacgggctcaccccggacggccggcatttccggtccgccgcgccgtggccagacgcggccgtgccgatccgggccgcctggtcggggcagacggccccgcagatgcggatgctgccggagctgctgagcccggcggacctgccggaccggcccggggagggcttcccgatcggattggacgagtccactctggaaccggtccggttcgatccgggcgccgaccagcacctggtggtcgtcggcgatccgggatccggccggaccggggtgctgcggttgatcgcgcagtcgatcgtggcccgttgcatgccggcggaggcccggctgatgctggtcgatccccgccgcggcctgaccggcgcggccgacggccggcacctgctgatccacgccggctcccgggcggcggtggccgacgccgtcgccacggtccggcaggcgatgaccgaacggcttcccggcccggaggtgaccgccgaacggctgcgcaagggccgctggtggcgaggaccggacctgttcgtgctggtcgacgactacgacctggtcgccggcacggacggcgacccgctggccgaactggtccccctcctgccgtacgcgcgggacatcggcctgcacctgatcgtcgcccgtcgcacggcgggcgcggcccgggcgatgtacgagccgctgccccgcatgctcaccctgctgaacagcgcgttcctgctgctctccggcagcccggcggagggccctatcgtcggtgacgtccgccccgccaagcagcccccgggccgcggcacgctggtcacccgggccggcgtccgggtggtgcagacggcgtacccgcaatagccgggcgcccggcggcaccggcccggggagagggtgcgggccgtccgggtgcgtcacaggatcatcaggccggggacggtgcggtgccggctcaggtgtcgcaccgcctcgccggccgggatcggggggcgccggccgggggccgtggtggcgtgccggaggtagtcggtggcgtgcccggccgccgccggcagggtgggataccggcgggccagcaggttgccgacggcgccccggccggcgaaggcggcgatcgaacgccagtgcgccggggcggccagccggccgtgcggtgtcccgggcgggtcgggcagcacggtgatccggtcgtagggccggctgccggccagccaccactccgcggcggtggccgcggcgtgcgacgacgactcgcaccagtagggcacgacgccggcgtcgaacgcctgccacggatcggtcatccggccggtgccgaccagggcgtgccgggcgcccggcgggggtgacagccacgcccggtgcaggtcggcgacggcggcgctgagcgcgtgcgggtcgctgtagagcaaccggtggccggccgatccgccggccgcggccacggtccggatctccgcttccaggccgggctcgccgctggtctcggcgtagtgccggggtgtgccggccggcgggtcggtccagtcgccggcgccgatccggtgcagcagccggccgaaggcgtcatcgccgccgcggtagtcggccgggtcgccgccggcgaccggcgacccgatctggaagctgtagccgggtgggccgccgtccaccggccaggtccgcaggtcgcggacgaacaggtggacgccgtccggaccgcgggtggtgaggaacgaccggtacgccgcgggcagcgtgcgccaccgcacctgcagggacaccgtcgcaccacacaggacgccgcgggacacgggatcgtgcacctgccgcacggtgaccccgggattgcggtccaggatgggcccggccaggcgggcgccccagtcccgggcggccgcccagtcaccggggtccccgcccggccacgggagggtgaccgtgaaggacgtcggcagccaggccgccccgcacgcggccgccaggtgcaccgcggcgccgtgcggcgagccgaggaccactgccggatagcgtggtgaccggtggtgcccggtcacccagcgggcgaccgcctccgcgtccacgtgcccggccagcgccaccggcagggcctcgccggcggcctccgcggtcagcgcggcgcggcgggcccggtccggcagctcgccgtgacggcccagcaccggcacccgggagagggtgtcgtcgcgacgatccccgggcggcaccgacagggcgagcagtgcccggccggtactgtcggcgcacatcacccggccggcgggcagggcgggcgtccaggccgggccgccggtggtgcggtgaacggtcatcgggcgtcctttccggagggacgcccgcgttccccggccgcgcgccggtaaaccgggggtcaccgcacggcgacggcacccggccatgaaatcaccgcgccgcgacggcacccagccgcgaaatcaccgcgccgcgatgacacccagccacaagatcgccgtcgcgacgacacccgggtaggagatcgccgcgcggcgacgccatcaccgcgcggcgacgacaccgagccagaagatcagcgggaggccgaaggcgagccagtaacggctgacggcgatcccctgctggcgtgccttgccggtggcgatgaccgcggggatcaggccgaagatgccgaagaacagcgtgaccacggcgaccggccagaccgcgggcggccgcatcggcatcgccggcgggtagccgtgcgcggcggccgaggcctgctgcgcgccggtgtacatggcggcgccgccggccgcctagctagctagggcgaccatcgcggtggtgccggccgcggcgccgaagccggcggtggccattccggccatgatcatcgggatgccgacgatcgcgccgatgatggtcaggctcaggagggcaccgaagaacatcatgaagaggccggagatcaccgaggtgccggcgacggcggcaccggtggccgcgaccgcggtgccgccggccatggccgccccgccgccgaccatcgccgcggcgccgcccgccatcgcgacgccgccaccgaccatcgccgcctgcccgggagccgccccgtaaccgggagccgcgccataaccgggagccgcgccataacccggagccatcccgtatgccggtgccggcatcgcatatccctgggccggcatcgcgtacccctgcggcggcatcgcgtacccctgcggcggcatcgcgtaccccggggccggcatcgcggaggccggggccggcatcgcggaggccggagccggagccggcatctcgaccgccggaccgtaggcgggcgcggccgcccccgaagccggcggcggtccgtaggccggaccggcgaaggtcgggtcggcgctgggcggcagaaggacgggctcggtgccgggcatgcggggtctccctgggcggcggtgatcgacgcccccaggattcggtagcccccgggcctacttgaggatccccaaaactttcggtcaaaaacccacaacttccggcccgcgctcgcgcggcaccgacagcggcgatctccacgtccgatcacgcgcagaaatcgatttgctctgatgaacatcttgacattccaaatgagcgatccctagtttgggcgccatcttccggaaacattccgaaactttcgctgccgagaggtggttcttcgatgacaccccgcaggactctcgccgtagtagccgcactgaccctgagcacactcggcctcgccgcctgcggaggcggtgacgactccagcggtggcaacgtcacgatggagctctgggagaacgccaccaccggccccggccgggcgttctgggagaaggcggccgccgactaccaggccgcccaccccaccgtcacaatcaagatccaggccgtgcagaacgaggaccttgacggcaagctgcagaccgccctcaactcgggcgccgcgccggacatcttcctgcagcgcggcggcggcaagatggccgcgatggtggacgccggtcaggtcaaggacatcaccgcggacatctcggcggagacgaagcaggcggtcccggaggcggcgctcaagaccgggcagatcgacggcaaggcgtacgccgtgccggtcgcgatcctgcccggcggcctctggtacagcaaggacgtgttccagaaggccgggatcaccgccccgccggccacgatggacgagttcaacgccgcggtcaccaagctgaaggcgaacggcaccccggtcgcgctcggcgccaaggacgcctggccggccgcgcactggttctacttcttcgcactgcgctcctgcagcaaggcgaccctggacgcgaccgccgagagtaagaccttcgacgatccctgctggaccagagccggtcaggatctgcaggcgttcgccgccacccagcccttcaacaacggcttcctgaccacctcggcgcagcagggcgcgggcagctcggccgggctgatcgccaaccacaaggccggcatggagctgatgggcgcctgggacccgggcaccatcgcctccctcaccaaggatgccaagccgctgcccgacctgggcttcttcccgttcccgtcggtgccgggcggccagggtgacccggccgcggtgatgggcggcacggacggctactcgtgctcggccaaggcacccagggagtgcagcgactttctcaactacctgctcaccaaggacgtgcaggaggcgtactaccggggcttcaacgcgctgccggtgaacagggcggcccagggcgcggtcaccgaggactacctcaaggcggtgctcgacacctacaacaaggcgccgtacgtgtcggtctggctggacaccctgtacggccagaacgtcggcaacgccctcaacgtcagcatcgtcaacctgctcgccggcaagggtgacgtcgccgggatcatcaaggccgtgaacgacgcggccaagaagggctgagccgcgtgcccgcacgacggggagccggatgggcgcagcggctggagatcgctgccctgtccggcccggcgatcctggtgttcctcgccttcgtgatcttcccggtgctgatggccgggtactacgggttctaccgctggaaggggttcggggttccgaccgacttcgtcggactggacaactaccgcaccatcctgcaggacagcgcgttccacgacgtgctgctgcacaacggcctgatcgtggtgctgtccctggtcctgcagggcccgatcgcggtcgggctggccatgctgctgaaccgccggatgcgcggccggtcgatcctgcgcgtgctgatcttcgtgccgtacgtgatcgccgaggtgatcgtcggcacggcgtggggcctgctgctgcagagcgagggcgcggtcaacggcgtgctgcgctcgatcgggctgggcgggctggccgcggactggctctccgacccgaagctcgccatctggaccctgatgctggtcctgacctggaagtacgtcgggttcgcggtgatcctgttcctggccggcatgcagaacatcccggaggagctcagtgaggcggccgcggtggacggggcgtcgttctggcagacccagcggcggatcaccctgccgctgctcggcccgaccgtccgaatctgggcgttcctgtcgattctcggtgcgctgcagttgttcgacctggtctacatcatctgggggcagtacgtcgcgtcgaccgccggcacctcgaccatggtgacgtacatggtcaccgaggggcgcaacgccgcgaactacggctacggcaacgcggtcgcggtcgtgctgttcgccatctccatgatcatcgcgctcgtgtaccagcgtttcgtgctgcgccgcgacaccgagggcgcgctcaccggagggcggtaggcatgaagagcagaacagccggcaacccggcggtctacctgatcgccctgctgctggtcggtctgatgctcggcccggtcgtctacatcgtcatcgggggcttccggaccaactcgcagatcatcaccgacccggccggcctgccccggccgtgggtgttcaccaactacgccgacgtgctggcgagcagcacgttctggcgccaggtgggcaactcggcgatcaccgcggtggcgacgacgatcggggtcgtcacgctcggggtgatggccagctacgtgctggcccgctaccggttccgcgggcggggcgcgatgtacgcgctgttcgcggccggcctgatgttcccggccacggtggcgatcacgccgctctacatcctggtgaagaacctgggcctggtgaacaccctgcccggggtgatcctgccgcagatcgccttcgggctgcccaccacgatcatcatcctggtgccgttcctgcaggcgatcccgaaggagatcgaggaggcggcggcgatcgaccggtgcagccggctcggcttcttctggcggatggtgctcccgctgtcggtgccgggcctgatcaccaccggcatcctggcattcatcaccagctggaacagctacctgctgccgctgttcatcctgaacgaccaggacagcttcacgctgccgctgggcgtgcaggcgttcgcgtcgcagtattcggtggacaccgcgaaggtgctcgcgttcacgtcgctgtcgatgatccccgcgctggtcttcttcagcctcttcgaacgccgcatcgtcggcggcctgaccggagccgtcaaaggatgagcaggtctccacagaaagggccgacgacatgacatcgctgcacgtggcgaccaccggagccgacgacaccgacgggtcggcgcggcggccgttgcggaccatcaaccgggccgcggcgccggcccgccccggcgacaccgtggtggtgcacgccggcgagtaccgggagtgggtgaccccgcgacgcggcgggctcagcgacaaccgccggatcacctatcgggccgccgagagcgagcacgtcgtcatcaagggctccgagcggatcaccggctggcagccggacggcggcacggtgtggacggtggccgtgccgaacacgctgttcggcgacttcaacccgttcgtcgaggaggttgccggccgcgacgtgaaacaggccgggtacgcccggcgcaacgtctacgccgcgggtgcccggccgttcgccggcgaacgcgacccggtgatcctggagtgggggaccgccacggtggtggtggacggcgaggaggtgcacctggcgaccgacttcccggccgggatcgacgaggccgcggcggtcccggtgggtgggcgggacctggaacgggtccggttcgccgacgccgagttcgaggagcgcgacggccgccccgccatgctcacgaccgacctgaccggcgtcatcaaagatccggagcggcggtacgcggcgggtccgatcgtcgctctcaccgcggggccgcgccgggtccgggtctggtgacgtcggtcagcggggcggcgtgtcggggtcgtgccgggtgatgccgcacggtgtgcccctgctcaacgcgtaccgggcctcgatcgtgtaggtgccggccgtcggcgcggacagctcggtccactccccgctgcgggccaggcaggcccgcggcaccgagtcgtcggcggccccgtcgatcgccagccacggtgaccaggccacccggaccagtgcgctgccggcctggggcatgtgcacggtgagcgcggccggcccggccgacacgacggtggcgggcgccgagaccaggggatcggcgccctccacccggtagacccgccagtcggcgtcctgccacaccagcggcagccagggctgcccggccgtgatgatctgcgcctcggcgatgcccgagctgtccggttccatcgcgggcagcaccacgtacgccacgctccagttggtcagccaggcacggtacgaatccggggtcagcgtgtcgtcgtagaacaacgggttgcgttccacgtcggcctgccggttccagccgcgggccagggcgatgtagggcgccaccacggacgcctcccagtgggtgcgcagcggcaccacctcgacccggctgcgctgggcgtccagccggagcagctcggtgatcagcgggcgcgcgtcggccgcggtccggtcggtcacccgggaggtgtggatcacgtcactgaccggctgcaccatggtccagacggcgagcgcggccgccgccagataggtcaccgtggcgcggcgggtgcggcgcgccggggccgcgcagaacaggatcagcgcgccgaccagcagcgcgagccgttcgacgttgctgccgatcggggtgggcagcgcccagcacagggccacgccgacggcgtacacccaggcaccggcccggaccgtgcgccaggccggcggggtgagcacgccgaccgcgaccgcggcggcgaccgtggccagcgcggcgtaccaggggaacggctgcaccccggagaacgggaacagcaacgaggtggccgcgatcaccaccggcgggccggccgccagcaggtaggcccggcgccgccggccgaccaggaacagcgccgcggccagcacctcgatgaacagcccggcgaccgggctgcacagggtggccagcgcgccgagggccgcggccagcaccgggcggtccgggcgcggcccgctgcgcggcggggcgagcagggcggccatcagggcgaacaccatgccgagcaggtaggtgacccggccggcggccaggttggcccagaccgcgatcgccagccacaccgacggcagcagcgggcggcgcacgccgaaccgggtcagggccaggccgcccagggcggcaccggccgtgcaggcgagcaccccggtggtgcggacgcccagccaagccatcagatacggcgagatcacgctgtacgacgccgggtgcatcccgccgtaccaggacatgttgtacgccgaccagggatgctcgcggacgaacgaggtccaggcgtactgggcggccaggtcgccggcgtcgtgtgcgaaccagagcgtccagaccagccccagcacaccggcgagcagcccggcgagtaccgccggccgccgcacgtggtcgagaagtgtcatcggatccgttcggtcgttcccccgccggtgacgcaagtgccgacccggacggcgcggaccgtaacacgagacccgggtaaaacatcaactccttgcggatcggaccgatgtacatcacgagcaagggagtgtcggatgcgcgtcgcactggtcacgctgtacgtcgctgcgggcctggtcgccgcggcgtactcggcgctgtcctggcgccggcggcaccgctcgtccctggcgatctcgctgggggtgatcctggcgagcgccgcgctctggtcgctggcccaggcggtggcggccgtcgccacgtcccgggcggtggggctcgccgccacctatgccatgttcccgggcgtcgcggcgctggtcgccgcgttcttctggcacaccaccgtgttcaccgggggcccgccggaagcgctcagagggcggctccggctgctgctcgtgcacccggtgctgctgaccgcggtggtggtgaccgacccgtggcaccacgcgttcttccggtcgatcagcgattatccgggcggtggggtcgttccgcacccgggcccgctgtactgggcacataccgcgtactgctacacgatcctggcgaccggcgccgcgcgtgcgatcggggcgatgcgccgggcggtccgcgggcatcggcgggtcttcgtcatcttcctgggcggcgcgctcgccccggcggccggcaacctggtgagcgtcgtggccgggctgggcgagcagcaggtcgatctgaccccggtgctgttcctgatcaccgcctcgatgtggtggtgggccgaacgggccggggtgacctcccggcggaccccggtggcgtacaagcaggtcatcgccgcgttgcaggacgcggtgatggtgctggacccggacggccggttcctggacgtcaacccggccgcggccgagttgctcgccgggctgaaccccgcggccgccggcgccgtggtgggccgccgctggcaggagatcaccgggccgcggctggcggcgacgttcgacggcgaaggccagcagacggtcaccgcggccagcggccgggtgtacgacgtgcgggtggttcggatgggtgaaccgggcggcgactcaccgggcaccgtggtggtggtccgcgacgtgaccgagctggaacggctccgggccgaactcaccgaccaggccgtccgggacggtctgaccggggtgttcaaccggcggcacctgaccgcggtgctggacggccggatccgcgaggcggtcgccggcggccatccgctgtcggtcgtgatgatcgacgtcgaccacttcaaggcggtcaacgacaactacggccacgcggccggcgacgaggtgctgacccggctggccggggagctgtccgcggcggtcggcacggccggcacggtggcccgctacggcggcgaggagttcgcggtcgtgctgcccggaaccggcgtccgggaggccgccgagctggccgagggatggcgggagcggtgcacccggctcaccgtgcccaccgcgtgcggcccgctgcggatgacgttcagcgccggggtggcgcagctgaccccgtcgacccgggccgaggagttgctgcgccgtgccgaccgggcgctctacggggccaaggaggccggccgcaaccgggtggtctgggactccctgaccgccgccaccccctgaccgccccgggtcagcccgtgaagccgccgtcgacggccagggccgcgccggtggtcgccgaggcggccgccgagcacagccaggcgaccgcggcggccacctcggccggggtgagcagccgccccagccgttggtgccgggcgaaatcctgggccccggccaggccgtaggcacgggccgtccgggtcagcagctcggtgccggtgctcccgggcaggaccgcgttggcggtgatcccggacgggcccaggtccgcggcgagggcgcggatgtagccgagcgcggcgtgtttggccgccacgtacgaggcgagcagcggcagcccgcgctcggccgcggacgatacgacggcgacgaaccggcatcgggacggatcggcggcgcccagcatgccggggatggcggcgcgggccaggttggccaccccgtgcaggttgaccgcgaggtcgcggtcgaggtccgcgggagactgctcccaggccgggccgtcggcggcgatcaccccggccaccgcgaccgccgcgaccggggtgccgccggccgccgccaccagttccgcctagctagctaggggcagccacccgggcgccggcggcccggcagtccgcggccaccgcggtcagctcggtgagggtggccaaccggtagcccaggccggtctcggcggccggaccgggcgcgtcgccgaggaccaggtcgtagtcggcggccagggcgcgggccaccgccgcgccgatgccgcggccggctccggtgatcaccgcgaccggccggacgggctccagggaatcgactctcatctccaccgcttccatttggcactcgatgccattattgtgatccgggacgggcggaaagaccagacggagggaccgatcaatgggcagggactggttcgagagcgtcgcagtggcgcagcgccgggcgcagcggcggcttccccggtcggtctacggcgcgatcgtcgccggctccgagcgcggcgtgaccctcgacgacaacctggccgccttcgccgagctggggctcgccccgcacgtggccggtcaggccgcgcagcggtcgctggccaccacggtgatgggccagccggtcgccctgccggtgatcatctcgccgaccggggtgcaggccgtgcacccggacggggaggtcgcggtggcccgggccgcggcggcgcgcggcacggcgatgtcgctcagctcgttcgccagcaagccgctgggcgaggtggtcgccgccaacccgcagaccttcttccagatgtactggatgggttcccgcgacgagatgctgcggcgcatggacgacgcccgccgggccggcgccaagggcctgatcgtcaccctggactggtcgttctcgcacagccgggactggggcagccccaccatcccggatcggatgaatctgtccgcgatgctgcgccacgccccggagacgctgcgccggccccgctggctgctggcctacctgcggcagcgccggatccccgacctgaccgtgccgaacctggccgacgacggggtggccccgaccttcttcggcgcctacggccgctggatgcagaccccgccgcccagctgggacgacgtgcgctggctgcgcgcgcagtggggcgggccgttcctgctcaagggcgtgatccgggtcgacgacgcgcgccgcgccgccgactgcggcgtgaccgcgatctcggtctccaaccacggcggcaacaacctggacagcaccccggcgccgatccgtgcgctgccggccgtggtcgaggcggtcggcgaccgggtcgaggtgctcctcgacggcggcatccggcggggcagcgacgtggtcaaggcggtcgcgctcggcgcccgggcggtgctgatcggccgggcctacctgtgggggctggccgccaacggtcaggccggtgtggagaacgtgctggacgtgctgcgcaacggcatcgactcggcgctgctcggcctgggccgcgccgacatccgcgacctgcggccggaggacgtggtcgtcccggccggcttcacccggcggctcggcgccggggtgcccgccgcgtccgccgcgcccgcggcctccgcggcgttcgaggtgatcggctgagcccgggtcagtcccgctcccggcacatcaggccggcgtcgcaccactcgtccacccggatctccacctcggtgcgcatgttgatccggtcgatgtcccacaggtccgccagcatgtcggcggcggcggtgcactgcccgcggtgctgccgcagcgcgatccacaccgccgcgctgacccggccccactgcaggcgccggccggtgtcgccgacgaagagctccaggtgcccgttctccagaatccgggacgtgacgcccggcgccggtgttgttcgcacgttgtccccgaaccttccgatgcgtcaggagctggccggcggtcgattccgatcgccggcgtgcagcggccccatcgggcccgccgccaacggatcaggaccgcgcggtcggcaccgcgcgtcgcggggtcgtcgacgtactcaccaagccggtgttctgcgatgagccggccaccgggagggcggccggctcgggtgccgggcggagcgtgggtctcatgggagaagcgtaacccacatctatacaaatgtcttaaaaatctgttcagtacgtcggaagtggggcgagcgtggtgctcagcaggtcgagcaccgcggccgcctggggcaccagatagaagtgtccacccgggaagacccgcaggtcgaagtggccggtggtgtgcgcggcccagtcccgcgcctcggccaccgtggtcatcgcgtcgctgtcgccggtcagcacggtcagcgccgaccgcagcgccgcgtccggccggtgccggtaggtctccaccgcgcgatagtcgccgcggatcaccggcaggaacatccgctgcagctccgggtcggtcagcagccgcgggtcggtgccgtccatccgctgcagctcggccaggatgccctcgtcgtcacgctgatgcacggattcgccgcggtaacacgacggcgcccggcgcccggaggcgaacacgtgcgtcaggtcgtgccgtccggcgtcctccaggcgcagccccacctcgtacgcgagcatcgcgcccatgctgtgcccgaagaacgccagccgccggtcggtcagcggggcgagcgcttcggcgatccggtcggcgagcacgtgcagatcggtgagctgtgcctcggaccgccggtcctggcggcccggatactgcacggccagcacctccatccgcgggctcagcgccttggagaccgggaagtagaagctcgcggagccgccggcgtgcgggaagcagaccagccggacgtcaccggccggcgcggggtggaaacggcggaaccacagccccggatcgggtgcttgctgggtcacggggagaacctctcggtcggtgctggtcaacagatctgcgccaccggggtggcggcgggctcgaggacgatgcggtgcccggtcgggtcccggacgacgcccgcctcgaccggcgcgccggcggccaccgcccgggccagcaccgcgcccggatcggcgcacggcagcaccagcggcgcgccgcccgcgaccgcgcccgggttctcgaccagctccagccggtacgggcccagcgccagctcggccaccagcgggtgaccgtcgagcaggcactcgcggctgacctcggcggcgccgaacaccgtcacgtagaacgcgatcgccgccgcgccgtcgcgaacctccagccgatggtctggccgatccatcgcgcacctccctgtacgagcctggagggacgctaaccaccccgggatccgggcggacacccttagatgcgccaccggtgccggggcggacgcggtaaggggccgggcaggggcccgcctaggggttcacagcaccgccgggactcatatgttcaccgtcgcggtcggctgaccgccccgccgacacccgaggacttaggcatgacaatactggccccgaccctcgtcggaacggagcgcttccgggctctgggcccgcgtcacatcgatgagatcgcggatcgctacggtcttcccgcggacctccgcgagtccgtccggctggtgtcggcggtgctcccgttccgggtcaacgagcacgtgctgaacacgttgatcgactgggaccggatccccgacgacccgatcttccagttggttttcccgcaggccgggatgctgtccgccgacgacggccggcaggtcgccgccgcgctgtccgatggggaccggacgcggctgcagacggtggtccgggacatccgcggccggctgaacccgcacccgtccggccagatggagcacaacgtgccgcgcggcgcggacggcgaaccgctggccggcgtgcagcacaagtaccgcagcacggtgctgtacttcccggggcagggacagacctgccactcgtactgcacctactgcttccggtgggcgcagttcgtcggcgacgccgacctgcggttcgccgcgcagagcccgcaccagctggtcgagtacctgcaccggcacccgtcggtcaccgacgtgctggtgaccggcggcgacccgatggtgatgtccaccgaacggctgcgcagccacctggagccgctgctcgcggtgccgaccgtgcgcaccatccggatcggcaccaagtcgctggcgtactggccgcaccggttcggcagcgacggcgacgccgaggaggtgctgcggctgttcgagcagatcgtcgcgaccggccgcaacatcgcggtgatggcgcacttcagccatccgcgggagctggagccggagccggcccgctgggcgatggagcggatccgggccaccggggcgctgatctactgccaggcgccgctgatcgcccgggtcaacgactcggccgcggtgtggcgcgagatgtggcaccgggaactcgcggccggcgccgtgccgtactacatgttcgtcgagcgggacaccggcccgcacgagtacttcaaggtgccgctggagcgggccgcgagcatcttccgggaggcctaccaggatctgtccggcctggcccggacggtgcgcggaccggtcatgtcggccaccccgggcaaggtgatcgtggacggggtgacaccggccggcgatggcgaagcactgcagctgcgtttcctgcaggcccgtgatccggccctggtcggccggccgttcctggcccaccggtcgccgaccgcggcctggctcgacgagctggtgctgcacccgtcgaccccggccgacatcgccgccgcggtcggctcggcggtgtcccgatgacccgccacatcgcccccaacatggccctggaccagcggatcgccgagcggcaggcggccggcgaacggatcgtgcacctcggcttcggcgaggcccggctgccggtcttcgccccgctggccgaacggctggcggccggcgcggcccgcaaccggtacggcgcggtggtcggcgacctgccggtgcgcaccgcgctggccggctacttcacccgccgcgggctgcccaccgagcccggccaggtgatgaccgcgccgggcagcaaggcgctgctgatcggggtgcagctggccctgcccggcgacatcgtgctgcccgcgccgtgctggaacacctatctgccgcaggcggtgctggccggcaagacgccgatcacggtgccgatcccggccggctgcggcggcgtgccggatccggagctgctgcccggggcgctgcgggcggcccgcgcggccggccaccatccgcggatcatgctgctcaccctgccggacaacccgaccgggacggtcgccgacccggagacgatccgccggctgtgcgcgatcgccgaccgcgaggatctctggatcctctccgacgagatctaccgcgacatcctgcacggtcccgaggtggccttccgcagcccggccgagctgctgcccgagcgcaccgtggtgaccaccgggctgagcaagaacctggcgctgggcgggtggcggatcggcggggcccggttcccggcctcgccgcagggcgagcggctgcgggccgacgtggccgcggtggccagcgagacctggtcggcgctggcccagccgatgcaggaggtggccgcgtacgccttcagcgagccgccggagatccgccggcacctggcggccggggcccggctgcacgccgtcgtggcccgcgcggtgtacgagatcatggtgggggccggcgccacctgccgcccgccggccggtggcttctacgtctatccggacttcgagccgctgcgcggtcacctggccgggcacggcatcaccgatgcggcgtcgctggagcacgaactgctggagaccgccggggtcgccgtgctcggcgggcaccaccagggcgacgacccggcggcgctgcggttccgggcggccaccagcctgctctacggcgacaccgacgcggagcgtgcggcggcgctggcggcggcggatccggtggcgctgccgcacatccgggacatcctggcccggctcgaggaaggcctggccaaactgtgccgataggagactcgcgggtgacgtacgacggtgcggcgatcgtctttcccgggatgggtccgctccgctacgcggaggcggcccgcttcctgatgttcaacccggccgcgcggcggctggtcgcggtcgccgacgagacgctcggctaccggctgctggatcgctggcgcgacaccgagggcgactattcggcgtacgcgcaggccgccttcctggtcacctgcctggccctggccgagtgggtggccgagacccacgacgtgacaccgtcggtgatcgccggtgccagcttcggcggcaaggcggcggccgcgtacgccggcgcgatctcggcaccggacgcgatccggatgaccgccgggatcgcccggtgtgaagaggagtacttccgccgcgagcaccgcgacgtggtcaccgtgtcgttcgcccgcaccccccgggagcggctcgacgagatcctggccgacctgaccgccgacggcgggtggcacgacttctcctgctacgtcgacgacgacctgcacatggtgtcgatgtccgcgcagcggctggactggttccacgcccgggtccgccaggccggcgggctgccgctctacgtcaccgacccgccgatgcactcggccgcgttcggtccgctgcgcgagatcgtcgagcgcgaggtgttcgccggggtgcggttcgccgacccggatctgccggtgctggccgaccaggacggcagcctgcggcgcaccgccgcgggggtccgcgacatgctgctggacggcctggtcatgccggtgcgctggccgcgggtggtgaccgcgctgcgcgacgccggcgtcggccgggtgtacgtggccggcccggacagcctgttcggccgggtccgccgcaccaccgacaacttcgcggtggtgaccgccaacccgcggctggcgatgacgccgcgccgccgcccgctgccggtctgagttctcgcgcccacggtcccggccggttgcccgaccgggaccgccgcggtcagaccgcggtcgggacgatgccggacagcgcgccccagagggtgcgcggggtggcgaaggtgtccatgctcagcatctcgtcggtgaagcggacctggtagcccttctccagcgccgagagcaattccacggtgcccagcgaatcgagtcccagatcacgcagatcggcgtccgcttcgagctgttcgccgctcgggagaaatggcaaacaatggcggaccatctcctcgaacttcacatcccacataatgtcgtctccctcgttgaagaatgcccttttcaggtcgacgaaagaacaccgccgggcggcgggcaacccctgtcgcgcccctaaagccgaaagaggaaagatggacgacgtcgcgctctcgctgccctcgagattcctgcgggggctggcgctgggccccggccgcaccgccctgcggatcggctcccagcgggtctcctacgccgagctgcacgagctcgcctgcgactgggccggcgccctgcgggccgcgccggacgggccgccggccgcggtcggggtgctggccggcaagaccttcgaaggttatgccggggtgctcgccgcgctgtacgccggggccaccgtggtgccgctgcacccggacttcccgatcgcccggacccggtacatgctgcagaccgccggtgtctcggcggtgatcgccgacccggccggctgggccgccctggaccggctgcacgccgaggggctgcgcctgcccgcggtcggtgacgggccggccggcgaccggctcaccatcggcgtccgcgccgccgacgcactcgccgggccggtcgcggccgacccggacggcgccgcctacatgctgttcacctccggctcgaccggccggcccaagggcgtgccgatcggccggggcgccgtcgcgcactacttcggcctgctggacgcccgctacgacttcggccctgacgacgtcttctcgcagaccttcgacctgaacttcgactgcgcgatgttcgacctgttcggcgcctggggggccggcgccacggtctgcccggtgcccgcgcaggcgtatcgggacctgcccggcttcgtcgccgaccggcggatgaccgtgtggttctccacgcccagcgcgatcgggctgatccgccggatgggcggcctgggcgcgggtgcgctgagcggactccgctggagcctgttcgccggggaggcgttgcgcgccgccgacgcggtggactggcaggccgccgcggaccggtccacgctggagaacatctacggtccgaccgagctgaccatcacggtcaccgggcaccggtggtcgccggccacctccccgcagcgctgcgtcaacgggctggccccgatcggcaccgtgcaccccggccacgaccacgtgctactcggtgccgacggcgcggaggtgccggccgagggcgagctgtgcatcaccggtccgcagatgaccaccggctacctcgacccggccgacgacgcgggccgcttcctggaccgcgacgggcggcgctggtaccgcaccggtgaccgggtccgccggctcgccgacggggagctggtctacctcggccggctcgactcgcaggtgcaggtccagggctggcgggtggagctggccgagctggagcacgcgctgcgcagctgccccggggtggaggacgcggtggccgtcacccggcccgccgaggaggggctggagctggttgtctactacaccggccaggtgaccccgccggcgctgctggcccgccggctgcgcgacatcctgccggccgggatgctgccccgcgtctaccgtcacctgggcgagctgccgctgaactccaaccgcaaggtggaccggggccggctggcgcgggacctagctagctagcgccgcggcccgccgcgcctcactcccggccggccagcagtgcggccttgtccaccttgccgttcaccgtgaccggcagctcgccgagcagccgcacctcggacgggatcatgtagtccggtagcgtctccttgcagaacgcgctgacccgcgcctccgtcaggccggcctcggcagcgacggccaggaacgcgcacagcaccggctcgccgtccggccgcggcggcgccagcaccgtggccgcgcccaccccgggcaggtccagcagccggcgttccacctcgccgagctccacccggttcccacggatcttcacctgggagtcggcgcggcagctgtagtagaacagcccgtcgccgccccgggtcgccaggtcgccggtgcggtacacgagctggccggagcgcggctccaccgggtccggcaccagcacccggccggtggtggccgggtcgtcccagtacccgctgaacagcgccgggctgcgcaggtacagctcgccgagcacgcccgcgccggacaccgggcggccgtcctcgccgagcagcaacagctcggcacccgggtgggcggggccgatcggcacgccgtcgccgctgtccggcaccgggtccggcacgtcggtgaacgagcaggcgatcgactcggtgctgccgtagcagttgacgatccgcagccccggccgcagcttgcgcagctgccgcagctcgggcagcgggaacggctcaccggagtagagcaccccgcgcagcgcggtcagcgtgcccagctggtcgggctcgtggcgcagcaccggccgccagatcgacggcacgccgttgacctgggtggcgccggtggccgccaggaagctcaggaaccgccggggccagcgcaggaacgggcgcggcacgggcagcaccgcggccccgctgcccagcgccaggccgatgtcgagcagcgagaagtcgaactgcagcggcgaggtggtggccacccggtcgtccgggccgacgatccggtgcgccagcatgccgcggaagaagctgagcaccgcgcggtggctcatcaccacgcccttgggccggccggtggtgcccgaggtgaacacgatgtacgccggatcgaccggggtgcaggcggtccgcccggtcggcgcgatcgccggcaggtgcgtcacctccaggctgtccggcccgaaccggccggcgccgagctccggcggcagcccggtgcgctctccctcggtcgtctgcaggtgcagcaccgcgccggccgccgcggccaccgagaggacccgcggagtgggcgtctccgggctcaccgggatgtaggtcaggccccgcatcgagcaggcgatcagcatggcgatcgccggagccgaggtgtccgcgtcgaccacgacccggtggccgatgccgagcccgagcccggccagcgcggcggcgtacgcctcggcccgctcgcgcagttcgccgtacgaggtggtccgcgactgctcgatcacggcgggcgcgccgggccgggtcgcggcatgctgcagaagaaattcatgcagcatttccggcgcatgtatttcgacaatggtcatgaatgcggagtctagagagaatcgcgggcgcggtggacccgggatagggggatctaggggtgggtgaaacggcgcgctgccgtaggttgccattcaattagcggagaaaaatggagcgtgcggccatgcgcgattctcgcgggaccggttcggtcggcgatcacctggcacagcggcgggccggtctggccggatcgctgcgcgacctgccggtgcccgagcaggtgcgccggctgcggagcctggtgaccgggcaactgctgccgatcctgcggacgatccgcccggccgaggagatcgtggtggccggcgccaccccgttccgcgagcagggtctcgactcgctgggcctggtcgacctgcacgcccggctgaacgccgccaccgggctggcgctgccggtcaccgtgggtttcgaccacccgaccccggatgcgctcgccgcgtatctgcgggccgagctcctcggtctggccgagagcggcgccgaggtggtggccgcggcccgggccagcgacgagccgatcgcgatcgtcggcatcggctgccacttcccgggcggcgccgactcgcccgagcaactgtggcggctggtcgccgacgaggagcacgtgcacatgccgttccccgccgaccgcggctgggatctggacaacctcttcgacgacgacccggagcgggccggcaccacctacgtgcgacacggcgccttcctcaccggcgcggccggcttcgacgccgcgttcttcgggatcggcccgcgcgaggccgccgcgatggacccgcagcagcggctcgtcctggagaccacctgggaggcgctggagcgggccgggatcgatccgggcaccctgcgcggtggccggaccggcgtcttcatcggagccgaaccgcaggagtacgcggtacgcctgcacgaggcgcccgacggcctcgacgcttacctgctgaccggcaacaccaccagtgtcctgtccggccgggtcgcctacctgctcggcctggagggaccggcgctcaccgtcgacaccgcgtgctccggcgccctggtcgcgctgcacctggccgccgagtcgctgcgccgcggcgagtccgccctggcggtggccggcggcgtggcggtgatcggcgcccccggggtgttcaccgcgttcagccggcagcgcgggctggccccggacgggatcgccaagccgttcgccgcggccgccgacggcacctcgttcgccgagggcgccggcctgttcgtgctggagcggctggacgacgcccgccgcaacgggcacccggtgctggccgtgctggccggcaccgcgatcaacaacgacggggccagcaacggcctgaccgcgcccagtggcgccgcccagcggcaggtgatccggcaggcgctggccaacgccgggctcaccgccgaccaggtggacgcggtggacgcgcacggcaccggcaccacgctgggtgacccgatcgaggcgcgggcgctgatcgccgcgtacggcccgggccgggacgcggaccacccgctctggctgggctcggtgaagtcgaacatcgggcacacccaggcggccggcggcgccgccgcgctgatcaagatgatcatggcgatgcgtcacgacctgctgccccgcaccctgcacgtcgacgcgcccaccccgaacgtggactggtcggcggggacggtccggctgctcaccgaggcgacaccctggccgcggcgggaccgcccgcgccgggccggcgtctccggcttcgggatcagcggcaccaacgcgcacgtcatcatcgaggaaccggccgccgtcccggagccggagcggcccgccgcgccggtcccgccctagctagctagcgatcgccgccggtgagccggacccggcggtggtcaccggcgtggcccgggacgcccggctcgcctacctgttcaccgggcagggcgctcagcggttcggagccgggcgcgagctgtacgccgcgtacccggtattcgcggccgcgctccaggacgccgtcgcccacctcgacctgcacctggccgtgccgctcggcgaagtcctgttcggcgcctccgccgacctgctggaccgcaccgagtacgcccagcccgccctgttcgcgatcgggacggccctgttccggctgctggagtcgtggggcctgcgcccggacttcctggccggccactcgatcggcgagctgaccgcggcgcacctggccggcgtgctgtcgctggccgacgcggccgccctggtcgccgcccgcggccggctgatgcagcaactgccggccggcggcgcgatggtcgccgtgcaggccaccgaggacgaggccggcccgctgcgcgacgccgatctggacctggccgcgatcaacgggcccgagcagatcgtgctctccggcacccgggacgcggccgaggcggccgccgcccggttcgccgcgctcggccgccgtacccgcttcctggacgtcagccacgccttccactcgccgctgatggagccgatgctggaggagttcggccggctcgccgcggtgctcgactaccgcccgccggcgatcccggtgatctccggggtcaccgggcgcccggccaccaccgaggagctcaccgaccccggctactgggtgcggcacgtgcgggccgcggtccgcttccacgacagcctgacctggctgctcgacgagaacgtcggcaccttcctggagctcggcccggacccggtgctgtccgcgctgggccgtgcggcggtcaccgaccgggcgaacgccccggtcttcgccggcacgctgcgccgggaccgcgacgaggcccgcgaggtggccaccgcggccgcgaccgcgcacgtccgcggcgcccggctggacggcaccgggctgttcggtgcgcccgccacggccgtgccgctgcctacctatcccttccagcaccagcacttctggctgcacggcgcgcagaccggccgggtcgacgccccgggcctcggccagatcgcggcccggcacccgttcctcggcgcggtcgtcccgatggccggcgccggtgcgaccgtgctgaccggacggctcgccctggccgaacacccctggctcgccgaccacgtggtggccggcgccaatctgctgcccctagctagctagctgctcaccctggtccgggcgcaggccgccgcggtgctcgggcacgacgacgccgggcaggtcgacgaggaccgggcgttcagcgagatcggcttcgactcgctggccgccgtggaactgcgcaaccggctggccgacctgaccggcctgcgcctgccggccacgctgaccttcgactatccgacctcggtcgcgctcgccggccacctggccaccgcactcggcgaggcggccggcgcaccggtccctgcgccgtccgccggcccggcgccgaccgacgagccgatcgcgatcatcggcatggcgtgccgctatcccggcgacgtcaactccccggaacagctgtgggacctggtgctgcgcggcggggacgcgatctccacgttccccgaggaccgcggctgggacccggacacctacgacccggcgcccggggtgcccgggcgcagctactccaacgagggcggcttcctgcgcgacgccgccgagttcgacgccggcttcttcgggatcagcccgcgcgaggcccaggcgatggacccgcagcagcggctgctgctcgaggtggcctgggagaccttcgaacgctccggagtggacccggcgagcgtgcgcggcaccgggaccggtgtgtacgccggcgtcatgtaccacgactggggcctgcgactcggcacgctgcccgaggagctcgccgcgtaccacggcaacgggagcctggccagcatcgcgaccgggcggatcgcgtacaccttcggcctggagggcccggccgtcacggtcgacaccgcctgctcgtcgtcgctggtcgcgatccacctggcggcccaggcgctgcgccggggcgagatcgggctggcgctggccggcggtgtcacggtgatgtccaccccggacaccttcgtcgacatgagccggcagggcggcctctcctcggacggccggtgccggtcgttcggcgccggcgcggacggggtcggctggggtgagggcgcgggcctgctgctgctcgaacggctctccgacgcccgccgcaacggccaccgggtgctcgcactcgtgcgcggctcggcgatcaaccaggacggcgccagcaacggcatgaccgccccgaacggcccgtcccagcagcgggtgatccggcaggcgctcggcgcggccgggttgaccacggccgacgtggacgtgatcgagggacacgggaccggcacccggctcggcgacccgatcgaggccgaggcgctgctcgccacgtacggccgggaccggccggacgatcggccggtccggctgggctcggtgaagtcgaacatcgggcacgcgcaggcggccgccggcgtggccggggtgatcaagatggtcctcgcgatgcggcacgaactgctgccccgcaccctgcacgtggacgaggcgtcgccgcaggtggcctgggactccggcgcggtcgagctgctcaccagcgaacaggcctggccccggtcggcgcgcccgcgccgggccggtgtctcctcgttcgggatcagtggcaccaacgcccacctgatccttgaggagccacccgcggccggacccgtcccgccggtcggtgacctgccgctacccctgctgctgtccggccggtcggccgccgccgtgcgcgagcaggccgccctgctggacacctacctgcgggaacgcccggacagcgacctgacggcggccgccctggcgctggcgacgacccgggccgcactgccgttccgggcgagtgccgcggacccccgcgacctggccgcgccggtggtgaccgaggccgggcccggccggaccgccttcgtcttctccgggcagggggcgcagcggctcgggatgggtcgtgggttgtatgcggcgtttccggtgttcgcggccgcgttcgatgcggcgttgaccgatccgggtctgcggggggtgatgtggggtgacgatgtcgaggcgttgaatgcgacgggtgtggcgcagccggcgctgttcgctttcgaggtggcgctgttccggctggtggagtcgtggggtgtgcgggccgatttcgtggccgggcattcggtgggtgagctggccgcggcgcatgtggccggggtgttgtcgctggatgacgcgcggcgtctggtcgctgcgcgggcgggtctgatgcaggccctgccgccgggcggggtgatggtcgccgtgcaggccgccgagtcggtggtccggccgctgctggtcgagggcgccgacgtcgccgcggtgaacgcggccggctcggtggtgctgtccggcgaacccgcggcggtcgacgtggtgctggccggcctgcccggggtgaagacctcccggctgcgggtgtcgcacgcgttccactcgtcgctgatggacccgatgcttgccgagttcgccgaggtcgccgccggaatcgaccacggtgtggcgcggatcccggtggtgtcgacgctgaccggtgcggtggccgacttcgacgccgatcactgggtgcgccaggtgcggcaggcggtgcggttcgccgacgccgtgcagcacctggaagccgccggcgtgacgcggttcgtcgagatcgggccggatgccgcgctcaccccgctgatcgacgcgaccggcatcgcgacccagcgccgcgaccgggacgaggtgaccgagctgctcgccgcgaccggccgggcctggacccacggcgtgcgcgtcgactggaccgcggtgcgcccggcgccggtcgccgcgctgccgcacgatctgccgacctacgcgttccagcggcgccgctactggctcgacgtcacccccgccggtgacgtcggcgcggccgggctcgacccggtcgagcacccgatgctggccgccgcggtcgtctctgccgccgacggcgggctggtgctcaccggccggctcagcgcggccggccccggctggctcgccgaccatgacgtcctgggccgggtcctgctgcccggcaccggcttcgtcgagttggcgctgcgcgccgccgaccaggtgggcggcgcgggcgtcgaggagctcaccatcgaggcgccgctgaccctgccggcccgcggcggcgtggccgtccaggtggtggtcggcccggcctccggcgccgggatccgcacggtggccgtgcactcccgcgccgaggccggcgcgccctggcagcggcacgccaccggcaccctcaccgccgtcgcggccgagccggacttcgacctgatggcctggccgccggccggcgccgccccgatcgaggtgaccggcgcgtacgagcggctgcgcgaccgtggctacgcgtacggcccggcgttccgcggcctgcgcgccgcctggcggcacggcgacgaggtgtacgccgaggtcgccctcccggagagcgcccacgccgacggccgtcgcttcggcctgcaccccgccctgctcgacgccgccatgcacgccgacctgctcggcgacgacccggacgcgccgaccctgatgccgttcgcctggaccggtgtcaccctgcacgccaccggggccaccgcgctgcgggtccggatccgccgggtgcgcggcgacgaggtgtccgcgatgtggatcgccgacgacaccggccgcccggtggccaccgtcggcaccctggtctcccgaccggtctcggccgcccagctgcgcgggtccaccgcggccggcgacgcgatgttccggatcggctggcaggcccgcccggtcaccccggacggccgggtgctgcccgaggccggcgccgcggcgcccggcccgctggtggcgctcaccctgcgggcctccggggcggatgtcccggccaccgtccgtgccgtcaccggcgacctgctcgaccggctgcgcgcctggctcgacgacgacgcgaccgccggttcccgcctcgtggtggtcaccgaccgggcggccgccgtgcgggacggtgacgacgccgacccgcgcaccgcccccgtctggggtctggtccgggccgcgcaggccgaacaccccggccggcttcagctgatcgacaccgacggcacgccggaatcggacgccgtcctggcggccgccgccgcgaccggtgagccggaactcgccgtccgggccggtcaggtgctgatcccgcggttcgagccggcgcccggcggcgaccgggagatcccgtggccgaccggcggcaccgtactggtcaccggcggcaccggcgggctcggcgccctgctggcccggcacctggtcaccgagcacggcgtgcggcacctgctgctcaccagccgacgcgggccggacgcgccgggggccgccgccctggccgacgagctgcgcgccgcgggcgccgaggtcaccgtcgtcgccctagctagctagccgccgggacgacgtggccgcgatgatcgccgcggtgccggccgaccggccgctgcgcgccgtgctgcacgccgccggtgcggtcgccggcggcaccctcgccgcgctcaccggcgagcacctggacacggtgctggcacccaaggtggacggcgcctggcacctgcacgacctgacccgggaccggcagctcgacgcgttcgtgctgatctcctcggccggcgggtcggtgctggcggccgggcagggcgactacgccgcggcgaacgtcttcctggacgcgctggccgcgcaccgccgggccgccggactgccggccacctcgctcgcctacggcatgtgggcggtcgacaccgggctcggcggcgcgctgggccgggccgacctggagcggatgcgccggctcggcctacccgccctggaacccgccgcggccctcgaactgttcgacgcggcggtccgccaggacagcccggccgtgctgctcacccgggtggaccggaccgcgctgggcgcccgcaccgacgagctcccggccctgctgcgccggctcgcgcccccggcccggcgccgtgccccggccgcgaccgaaccgaccgcgttcaccgaccggctggccgggctggccgaggcggacctgctgcgcaccctgatcgacctggtgcgtggtcaggtcgccacggtcctcgggcacgagggtgccgcggcggtcgcccccgaccgggcgttccgcgagctcggcttcgactcgctggccgcggtggagctgcgcaacgcgctgagcgccaccacgggtctgcggctggccgccaccctggtcttcgaccatccgacgccgcgggcggtcgccaccgagctggccaccatgatcggcggccggccggcggccgagccggcggcgccggagcgcccggccaccgtgcgcccggccgacgacccgatcgccatcgtcgggatcagctgccggttccccggcggggtgcgctcggccgaggacctgtggcggctggtcgccgccggggaggacgcgatcggcccgttcccggccgaccgcggctgggccggggacagcatctacgaccccgagccgggggtaccgggcaagacgtacacccgggccggtggtttcctctacgacgccgcctacttcgacccggagttcttcggcatcatgccgcgtgaggcgctggccatggacccgcagcagcgcctgctgctggagggcgcctgggaggcgttcgagcgggccggcatcgacccggccgggatgcgcggcagccgcaccggcgtctacgccggcgtgatgtaccacgactacgccagccggctccccgagatccccgccgagctgaccggatacgtcggcaacggcagcgccgcgagcatcgcctccggccgggtcgcctacaccctcggcctggagggcccggccgtcacggtcgacaccgcctgctcgtcgtcgctggtggcgatccacctggcggcccaggcgctgcgcaacggcgaggtcgccatggcgctggccggcggtgtcacggtgatgtccgcgccggagatcttcgtcgagttcagcgagcagcgcggcctggccgccgacggccggtgcaaggcgttcgcggccgccgcggacggcaccgcctgggccgaggggctcggcatgctgctgctggagcggctctccgacgcccgccgcaacgaccacccggtgctcgccgtgatccgtggctcggcgatcaaccaggacggcgcctcgaacgggctgaccgccccgaacggaccgtcccagcagcgggtgatccgggccgcgctggacgccgccgggctcgccccggccgaggtggacgcggtcgaggggcatggcaccggcacccggctcggcgacccgatcgaggcgcaggcgctgctggccacctatggccgggaccggacggacgaggacccgctctggctcggctcggtcaagtcgaacatcgggcacgcccaggccgcggccggggtgagcggcctgatcaagatggtgatggcgctgcgccacgagcagctgccccgcacgctgcacgtggatcagccgtccccgcaggtggactggacggccggggcggtccggctgctcaccgagccggtcgcgtggcaacgcggtgggcgcccgcgccgggccggcatctcctcgttcgggctcagcggcaccaacgcccacctgatcctggaggaggccccggccgagccggtgaccacaccggtgcgcgttcccggcccggtgctgctgccgatctcggcccgcaccgcggcggccctgcccgaccaggccggtgcgctccgcgcccacctggccgagcagccggacgcggacctgggcgacgtcgcgtactcgctggccaccggccgtgccgcgctcggccaccgggccgtggtgctggccgccgaccgggatgcggccctggccgggctggccgaggtggagccggtgaccgccggcgacgggctgaccgccttcgtcttctccgggcagggggcgcagcggctcgggatgggtcgtgggttgtatgcggcgtttccggtgttcgcggctgcgttcgatgcggcgttgaccgatccgggtctgcggggggtgatgtggggtgacgatgtcgaggcgttgaatgcgacgggtgtggcgcagccggcgctgttcgctttcgaggtggcgctgttccggctggtggagtcgtggggtgtgcgggccgatttcgtggccgggcattcggtgggtgagctggccgcggcgcatgtggccggggtgttgtcgctggatgacgcgcggcgtctggtcgctgcgcgggcgggtttgatgcaggccctgccgccgggcggggcgatggtcgccctgccggtgcccctggaccgggtcgagccgctgctcaccgcgggggtggacatcgccgcggtgaacggtccggcctcggtggtgatctccggcgccgaggacgaggtgctgacgatcgccgccgccttcccgagcgcgcgccggctgcgggtgtcgcacgcgttccactcgtcgctgatggacccgatgctcgccgacttcgccgaggtcgccgccggaatcgaccacggtgcggcgcggatcccggtggtgtcgacgctgaccggtgcggtggccgacttcgacgccgatcactgggtgcgccaggtgcggcaggcggtgcggttcgccgacgccgtgcagcacctggaagccgccggcgtgacgcggttcgtcgagatcgggccggatgccgcgctcaccccgctgatcgacgcgaccggcatcgcgacccagcgccgcgaccgggacgaggtgaccgagctgctcgccgcgaccggccgggcctggacccacggcgtgccggtcgactgggccgcgctcaccccggccggccggacggtcgacctgcccacgtacgccttccagcgccgccgctactggctggaggcgcccccgtcgcgtcccggcgacccggccggactgggccagcacgacgccgcccacccgatgctcggcgcggtcgtggtcgccgccgaatccggcacggtcaccctgaccggccggctgtcggtgcccacccacccgtggatcggcgaccactcggtgctcggcaccgtgctgctggccggcaccagctacgtcgaactggcgctgcgggccgccgccgaggtcggctgcgacgtggtcgaggagctgaccatcgaggccatgatgacgctgcccgaccagggcggcgccgcggtgcaggtcgcggtcggcgccccggacgcggccggccggcgcggcttcaccatccactcccgggccgaggacgccccggccgaggtgggttggacccggcacgtctccggcttcctggcccccggcgcgccggtcgccaccaccgcgtcgttcgggctgaccgcctggccgccgccgggcgccgagccggtcgacatcagcgacgtctacgactacctgaccgggcagggctaccactacggcccgatgttccgcggcctgcgcgccgtctggcggcagggccgggaggtcttcgccgaggtggccctgccggacgaggcgcgctccgaagccggccggttcgggctgcacccgtcgctgctggacgccgcgctcagcgccaccgacttcctcgacgggcgccgcccgcaggatgtcggcggcacccagctcccgttcgcctggaccggggtggccctgcacgccggcggcgccaaccggctccgggtccggatcaactgggtcggctcggatgccggcgccggctccgaagcggtccggctgcagctcgccgacccggccggccggccggtggccacggtcgaatccctggtggtccgcccggtcaccccggaccgggtggccgccgcggccaccgcggccagcggcgcccgccggctggacacggtgttccgggtgaactggacacacctaccgctgggcggggcgaacacggcggtcgccgggcgctgggcggtgctcggcgaggacgtcttcgggctcggcccgaccgtgccggtcttcgccgatctgaccgccctgcgcgccgccggccggccggctcccgaggtggtgctgaccggcaccgcgccggccgggggagacgtgcccggcgccacccgggaccggttcgacgagatgctccggctgtgccaggagtggagcgccgaccagcggttcgcccagtcccggctgatggtggtgaccaccggcgcggtcgccgtcgacgacgaggccgccgaactcacccaggccccggtctgggggctggtgcgcgccgccgaacaggagaaccgggaccggttcgtgctggtcgacgtggacgacccggggcgggccgcgccgctgctggcccccatcgcggcggccggggaaccggaggcggcggttcgcggcagccaggtgcgggtgccgcgcctgacccgggccaccgcaccggccaccggtcatccggcgccctgggatccggccggaaccgtcctgatcaccggcggcaccagcggcctcggcgcagtcctggcccggcacctggtcaccgcgcacggcgtgcggtatctgctgctgctcagccggcgcggcgcggacacgccggaggccaaggcgctcagcgccgatctgaccctgctcggcgccgaggtcaccgtggccgcctgcgacgtcgccgaccgggaggcgctggccggggtgctcgccgcggtgccggccgaccggccgctgcgggccgtggtgcacgccgccggggtgatggacaacgccatgctcggctcgctcaccgcggaccgggccggccgggtgctgcggcccaaggtggacggctcctggaacctgcacgaactgaccggagacctggacaccttcctgctcttctcgtccacctccggtctgctgatcggggccggtcaggcgagctacgcggcggccaaccggttcgccgacgcgctcgccacccaccggcgggcggccggactgccggccaccgcgctcgccttcgggctctggaccaccccgaccggactgggcggtggcggattcgacgcggcggccgaggaacagcggatggcccggctcggcatgccggccttcgacacggccgacggactggcgatgatcgacgaggcgctggcgctgggggaggcgtcactggtgacgatgcgggtggacaccggggcgctggccgcggcgccggccgcagccgtgccaccactgctgcgggagctggcgggcacgccggtgacgcgtacgccgcaatcgtcggtgaccgccgtggcgcccgcaccggaggcgagcctggagcagcgactctccgccctgaccggcgcggaacgcgccgacctcctgctcgacctggtggtggcgcacgtcgcgcaggtccgccacgacgaaccggacgcggtcgaccggacccgcggcttcaccgaactcggcctggactcgctggccgcgatcgaactgcgcaaccggctcagcacggcgatcggcatgcggctgcccgccaccctgatgttcgactacccgaacccgacggcgctggccggattcctgctcgaagagctggagccgaccctggcaccgccgccggccgcgccggaccccgacgccgaacggctccaggcggcgctggccgccctgaccccggcccggctgcgcgaggccggactcttcgaccgcctgctcgcgctggccgcgggcgacaccggcccgtcgatcgaggagatggacgtggccgacctcgtggcggccgcgatggcgaccaccgacaacggaggagaatgatgccgacagccaagggaaccgtcgcgttcggcccgcaccgcacctggtaccgggtgaccgggcagctcggcgccggccgccccgccctcgtcgtgctgcacggcgggcccgggatcacccacgactatctgaagaacatcgccgacctggccgccgacggctggccggtggtccactacgaccagctcggcaacggcgggtcgacccacctgccggagcgcggcgccgacttctggacgcccgcactgttcctcgccgaactcgacaacctgctcaccgggctcgggatcgccgacgactacgtgctgctcgggcactcctggggcggcatgctcggcgccgcgcacgccgccacccgcccggccgggctgcgcggcctgatcgtcgccaactcgccggcgtcctacccgctctggctgcaggagatgaaggtcctgcgcgaccggctcccggacggggtgaacgacaccctgctgcggcacgaggcggccggcaccgtcgacgaccccgaatacctggcggcgagccgggcgttctacgagcggcacgtgtgccggcgggtgccctggcccagcgactacatggcctcgttctacgagctgtacaacgacccgaccgtgtaccggacgatgaacgggccgaccgaattccacgtcatcggcacgctgcgcgactggtcggtcatcgacctgctgccctcggtcgcggtgcccaccctggtgatcagcgggcggcacgacgaggccaccccggccaccctccagccgtacctcgacctggtgccggacgtgcgctgggagctgttcgaggagtccagccacacgccgaacctcgaggagccggaccgtttccgcgaggtgctcggcgccttcctcagcgagttgacaaggagcccgcgatggcagcaggactgaccgaacggacgtcgatcgccgggttccgcgaggcgatggcgtccttccccagcggcgtcaccatcgtcaccaccaccgaccaggacggccactggtgcggcttcaccgccacctcgttctgctcgctctcgatggacccgccgctggtgctggtctgcctggcccgcaccgcgcgctgccaccccggcttccggaccgcgcgatcctgggtgatccacacgctgacgccgggccaggccgggctggcgatgcggttcgcggaccggacggcggacaagttcggcggcggcgaattcgtggccaacgcgcagggacacccggtgctgcccggcgcctgcgccatcgtcgaatgcgacgcgtactcgcagcacgaggcgggcgatcacaccatcctgatcggacgggtcaccgccgcccgggtgcaggcggccgagccggccgtctacttccggcgcggcttccgcgaactgtcctcctgactcccggcccccttgccatccccctgcaccatggggccgtgacggaacgggaacaggcgttggcgatgggctccatcgcggagtatggccgctacgtgcgattcgcgtgtccggcctactccggtgaatggctcttcttcgccccgatcggcacgctgacgacggccggcggcatcgtgggcatcgtcaagggcggcggcggcctggcagactggatcttcctgccgctgagtctgatcgtgggcctggcgatggtcggtctgtgcttccggccggcgttcgagcggcgccgaggcggccccacgccgcggctctactgcttcgaggacggtgtcgtggtggccacccgcggcgagctgcgggcgttccgctggaccgagctcaccgtgcacagcgtcgactggacctccggcagcggggagaactacagcagcgggacgcgccggacctggaccgggccggacggggccgaagtcgtcaccttccgcggggacgagccggagcgggccggggaccgggacatgcgcaagctccacgaggcggcgctgcggtcccggtgagatcggggcgcccgggccggccacgatgtcacgcgtggtggtgcgggccggtcagcacccgcagggactcggccagcagcgccggcaggtcggcggtctcgtcctccagccagacctcgtacgcggcgagcgccgcgcccagtgcacagtgaccgatcgtcaccgggtagagctcgtccgggcggccgccgcgccgggccgccacgaaatccgcgatcacctgccgccactgcacgaaccgcagcgtcgaatcggcccgcagactgggcacccgcaggatcagggccatccgctcccggtgcagcgccacctgcgcggccgggtaggtgttgaacgcgatcaccccgtgccggatcgcgtccagcatcggccggtcggccggcaccgccgcgaaccaggcccggaacaccgccagctcgccgtcgaagtcaccccagaccaggtcgttcttcgaggcgaagtagcggaagaaggtacgccgcccgatgccggccgcgtcgctgatcccgtcgatcgtggtggcgtcgaagccgctctccgcgaacagccggaacgccaccttctccagatggtcccgggaggtgatctgcgggcggccggaccgggacttggccgcggaagcatcctggtgcgttgccatggtgaaggcagtctaggacgccgccggttcagcccggctttagcgcggggcaagggcggcgttagtgcgccccgctacctttctcgggacacagggaagtggtcggggtgaatgggtgacggatccggcaccccgctgacaagcggaggcgctatgagcgtgaacggcaagtggcagatcgtcgtcaactccccggtcggccgccaggaggccatctgcgagttcgaggccgagggcgccgtgctcaccggcaagtgctacagcaacgacgtcgtggtggagatccaggacggcgtggtcgccggcaaccaggtgaagttcgtctgcaagatcaagcagccgatgccgatgaagctctcgtacaccttggtgatcaacggcgacaagatcagtggtgaggtcaagccgggcctgttcccgaagcaggccgtcaccggcgttcgcctctgagcccccggtacaactgctcgtcgccgttcaggatggcgaaatgcaggtcggcgagggcccggccgggctccacgccgacctgctcacgcagcaccgcccgggcatcctgaaacaccagcagggcgtcggcgcgccgatccgatcggtacagcgcgatcatcagctggtgccggaacgcctcccgcaacggctgctccgcggtcaacccgtacaaccggcccaccagatcacggtgccgccccagcgccagccccgatccgatcagcagctcgtgacactccagccggagctcctgcagccaggtggcgaacgcccgcacccgcgcgctgtcgtgcaacccgtccagcggcgtgccccgccacagcgccagcgcctcctccaacacggtcaccgccgccgcgtgccgcccctctcgggccagcgtcctgccctgcgccagcagcgactggaagacatggtgatccacctcgcccatgtccagcgtgaccaggtagccgttcttctgcgtggcgatgctcagatcgccgtccgccggccgcagcaccttgcgcagccgtgagatgtacacctgcaacgccgccaccgcccgacgcggcggatccgcgccccagatgtcgtcgatcagctgctccggggtggccacctgcccggcccggatcaacagcagcgccagcagcagccgcatcttgtgcggccccggatcgatctcgtccgggccggtacccacccggaaccggcccagcaccccgtaccggacctgccgcacgccggccgggcgcgcgaccgtagtgacgagtgtgctcatcgtttcgccccatcctcgctgacatctgcccggccacggtgccgttcagcgggtgggcggcccacccgcaccaacccctaacctgcaccgccccggtgcccggcctccggccgcgccgggccggggcgtcgctggtgggggtacgcacctgcgcccggccggagacccttcgcggggccgcttcgttccggcggtcttcccacgcgtcgcaccgccctcacggcttggttccgcgcgtccgatcgcctggggaagatctccgggagcaggagctgcggggtgagagcggtggtgtctgaagcggcgtggttgctcgagccgggggtcggactggaggtcgccgggccggcggcggtcgggtcgggggcggtcggaccttgagtctgccgttcaacctccggctccggcctggcgtccccgcggaccagcgccgctgcgtcatccagggtgccggcgatcgagccgctgcgggtcgcgaccagccacgaccgcgcgttgtccctagctagctagaatgcggttacatgctcgatgtcagagcatagcggatgccgccggggggaaatttaatgcgctttgggttccacgctgcaggcgcggagcccttccgtgaccatggttatagcacgggctcgatcaaactctgccactcattgccggcccacgcctcactcacgcccgaccgaaaagatcgaatctcacctaggtgcgcttatcaaagcgagccgaaaaaggttaggctatctcgttacctgcgtgatccaatcgcggtggttccatgcgcatgtcgtcctcgttctccggatagtattgcgcgggggtactatgcttcttgaattcttctatcgcttcgtcgatttcctcgggtgtggcatggctaggaggaagatttgccagggcgatcgcggaattttctttccacgcctgttcgattacctcccatcggctgagcgtgtgttagctgaccaggcggacatggcgtgacgagcccgaaaggcgcggtgcgcactatccgcggctagaggagtaagccggccacggtcaaagaatcacggctcgagaaacgcctcatcgtgccaaatatactcatagcctggagcgaggatgacgccgatgccgggtgggagagccaggtaggccaccaactcgggaaagtggatgttggcgtgctcgacgtggatcgggctgaagaagtcgtcatcctgtggcgccgggccgccttgccatacgtaccaaccgttggactgcccgacgggagagtgacggacggcattgatcggcagcagccctgagctgcggctcaagccgacgccgatcatcgtcccacggcttggaagaagcggcttgaccccgaaacgccggcagactcggcgttgcgctcaagagatcacatcgcatccttgcatgcgtgcggcgcaccgtgggcggtgcgccggtccgagtagaaggctcgacgcgtgcggattgcggcagatgagcgtgcctccggaggtgaggcccgggcggtacggatggttctatcgcgacgagcgccccctttctattggcctttcggtgcgggggcgggtcagggatctacgtcgcgcgcgggtagtacggcattgatgaggtctcgcgtagccgcattgagttctatgacgtcgatggcgttgttcgagttggcgccggcaatgttgtcgaaaaggatgccgtcgatgcaggcgacgagccatcgcgcttggcggggaggatcgctggcatgaagtccggcgagaatcaccgtgatccgctggcgcaggccgcttccggaatggcggagttcggcggcgacctctggccggcgcaccgactccaaggtgagttcgtagcgggccaggtggcgctgtcgaccggtggtcagccagcggtgcaggacctccgcaagggattgagccaaggtggtcgggtccgacgcagtgatcgtggatgccatagcgtcgagttcggtgttgtcgtgttccaccagtcgctggacgcaggcactcagcagagccgcgcgcgaccggtagtagtaggacgttgagccaggtggtaagtcggcggctgcgtcgaccgcgcggtgcgtcaggcctcgtgaaccatggcgggccagcacgtcgagggcggcgtcggcgacaagctggtgccgcgcagagatcatgagcacactctaccgccgtagaggttgttcagccagtctctacagctgtagggtcacctctatggatgtagaggaacggcgatcggcggcaatagtcgggggtggcatcggggggctcgccgccgccgttgccctgcaccgggcggggtggacggtagcggtctacgaacgatctccaacccggagcgggatcggtgcggggctgaccttgtggccgaacgcggtgcgagccttgcatgccttggggctcgccgaagcgctacggtcccgggcgatggccgtacgcgctacggccgtgcgccgccctgacggccgttgcctgacacaaacccatgccggccagttgctttcccgttacggctctccgcagatggcgatcgtgcgagctgatctggtggagatgctcgcgtccgcgctgccgcccgggtgtctgcggccgggcatgaacgttaccgacatcgacgccggcggcctggaccggcaagcaggcatccgctgcggtgaccaacttatccgcgccgatctcgtcgtcgcggccgacggcgtcaactccgggctgcgccaggcgctctggccggcccagccgccagcggagtatcgcggatacgtggcctggcgcgccatcgtgcgcgccccctcagcccaagtcggcggggccagtgagacgtggggccgagcagcgcggttcggtatcgttccgataggcgatgacctggtctatctctacgccaccgcgaccaccactgctcgcgagcccggcgcggacgaactggtcgacctccgccaccggttcaggcactggcacgacccgattccggccctgctcgatgctatcgaacccggcgctctgttgcgccacgacatcacggcgctacatccgccgctgcgacgtcttcaccacggcagggtggcgttcctgggcgacgccgcccacgccatggagcccaatctcggccagggcgccggcctggccatcgaggacgccgtcgtcttggcacacgcggtagccgacggttcgtcgatcgtcactggcctcgccctctatgaccaagcccgagccggacgcgtcacccggctcgcccagcagtcccgcctactgggccgactcacgcagagtccctccgctgccgtcgcagccttgcgcaacatcaccattcgcctgatacccgatcggctcgcgctgcgcgggttcgacgccgcagcaagctggcatccgccgacgctgcgtccggcaaccaccacacaggagcacctatgaacccccaaatttcgccgcgccgcagcgcctgcgccatcggagcctggtctctgatcgccaccggtgccgtccatgcggccgccatcgccttgggcaccgcagcagccacacctcccgccgaacgggtcgcccgccaggcgatggccgccacacacgtcgacatagccggaatcgaccgcaccctgtggcagcttttcaccgggttcagtgcggcaatggcactattcatcttcggtctgggagcactgaacctgctcgcgctgcgccgcgcaccacaactgttcttcgacactcgggccgctctcgcgctcaacctcagcatcctgcttccggcattcgttctgtcagtcctgttattccctccgccgccgatcgtgttcctcggcgccagctgcgcggcattcggatacgccctcacccggtcttccacgcgaacccgagggtaaatggctagctagctagcgacgaacgccatcgagagcgtgaacgcccggatccgccgggcggtccgggcccgcgggcacttcccgaatgagcaggccgccctgaaatgcgtctacctcgccgtgatgtccctcgacccgaccggcaccggccgccgccgctgggcgatccgctggaaacccgccctcaacgccttcgacctcgccttcgaaggacgactcaccgcaggccgcaactgaccttcaacaacatcgagttacaccgttttcttgacagtcccggtaaatgcggaaaagtcaaattctcatcacagcttttggtacgaaaggaagcgaactgaggcagatcggatcgcctcatctcggcatggtcgcgtgtctgacctggcctacgttccggaggccatgaaggcggccaggatgtagttcgggtgtcggtcgaggttcttgcgggcccggtcgtagcggatggtggtgcgcgggtcggcgtggcgggcagcgatctggacgtcgcggaggttaacgccggcgtcgagcatggtggtgacgaaggcatggcggcgatcacctcggttgaggtcggagcgctatgtccgcggcagatccgcgcacccagatcggtcccgctccgtcaaagcgggggaactcaggtgcagcggtcagaaatgcactgtggcatcgtcagggcgatgatctcgatgcgggcgtcagggagatgaagtgatcataattgcgggaaggcttcacgttgcaccggccgatcgtgatcgctacctcgccgaggtggcgaacgttgctcgcttggctcgcgaggccccgggatgctcggacttcgtgcaggcggcggacgcactggacgacacgcggataaacgtctacgagcgatgggaatctgatgatgatctgcaccgattccgtgccgcaggagggccggccttggaccttccacccctacaggacgcgaacgtacggaagtacagaatctccagtgacgaggagccgtaacaacgcacgaacggcgcactcacctcggcacgacaagacgcgggtccgtcacggtcgtccccggtcgtgacggctgcggcccgctgccgcatcattcccgcgaaatgaccggtggcagctgccagcccagaagcgacagcatgtcagggcggggctcatcggtcggccgtaccgtcaggttgcgacagcgggtctgaagcagagcaagagcccgctccgagacgacgagcccctcgccccacccgtagaaaaagtccgccgccggatccccgccgacgataaggcggaccagctcgggtggggtcataacccccgcgccgtcgaaggcgtcttcgtcgtacgtggcccgcgccggaccggtgatgaaaccggtgagcccatctgccaacagtgccgcaaccaactccggactggcggctagttccggcgggcggccgaccaacgggtcgggcacccacgacagcacgacggtgagcacgccgtcctggtcgtccgacccgtcccaagccggatccggatcgatctcgtatcggcgtggcacgccgctcgcctcgtcggtgctcatggcttgaacctatctggatctgatcaagacacgtcagcggccggggctgcccccgcgccgccgggccgggttcagcgcggcgggcgaacgccgctgccgggctgggcggcctcgggccggtcgtgacggcggccgggtggccggccccgcgcggatcgcggcaggagagtgcgctgtcgcccggctccggaagccgcaggtatggtggcgtccgctgaccgttcaaggtgcagtccacaaagagggtgtgggatgtcggattccatgggaaatgcggtggaggtatcgctgccgtcggaggccggcgtgatcgtggatttggcgccgatttccactggcgggtccgcttggctgtttctggacgatgccgggcagatcggcaaatgggatcgcagcacagcgacggttcggcatcttgcgacaacgacggtgcccgacgaatcgggccgtgagccgtggaacggtcgcgttgttcgtcgacgtctgcatgcctctgccgacggagcttttgctgcggtggtgaacgattatggccgcttcggtgaggtgttggacctgggggccggcggggtcacattaaccttggacggcggcggatacgaggaggggactgtccctttctccctcgttttcgccgagcacgacggcgctacggtggtggtgcaccgcaccaattggaaccgcttggacgtgtcgcacgccggcacgggagcgttggtgaccgctcgatcgtcgacgtccaccgattcacacatggagagtgagcacggtctcgactacttccacggtgcgttgtatctcagccctgacggtcggcggatcctcgacgatggatgggtatggcatcccgtcggtttcccggtggtgtggcgtatggaccagtggctgtccgtaaacccgtgggaatccgaagatggccagagccggatgggcctgtgcggccgggaatactactgggatcacccgatggtctggatcgatgaaactcgggtagccgtcgaaggcatcggcgatgacgccgatgacatccggcccggggctcggctgttcgatacgacccggtccagccagggcggattgtggcgagaggagaccgccgtcgaaacggcgtgcatccccggcccgtcgggccgcttcttcagcgacggggtgcacctgttcagttccggcgatgacgaactggcggcttgggatctggcaaccgctgctctggtcggcgttgtcagacggtttgcgcccacccattacaaccggcacacaggcgagtttctccagctcagtgacgaaaacagcgtgctggtttgggcgcacccgaagacggcgagctagcgcactcaattcgcacgaccagccctcgccagcgcgtgcaccgaaacccagccgccgcggccccggacgcccggctcccgcaaccggcaacccgctggccgccacgacgtcgggctcatcccggtcaccgggcaggcgcaccaacgaccggcccaccacgagaagggcatcaagcccgccgaactggttgaacgacaagctcaggtggccgggccggggatcgccgggccggcggtggtcgggccggcggtggtcgggtccagggcggcgccgaggagggtgcgcagggcgcgggcgtggtcggtgagggcgtggcggccgctgtcggtgagccgggcggtcgcgcggcggccggtgcggcggacctcgacgtagccggcgtcctgcagggtggtcagctgtttgctgagggccgagtcgctgaggccggtcgcctcgcgcagatagctgaagtcggcgtgggcggcgggggcgagcagggacaccagggacagccggaccgggaagtgcagcagttcgttgaagccgtccggccgtgcggtggtcatgccgggttccgcggggcaccggcggcggcctgggtggggccgatggcggtgatccagaccagggccccggccaggccggacagggtgccgtcggccgggacgtcgagcaggcgcagcaccgtgccgacgccgatgacggtggccaggacggcggcggcgaacagggcccacggggcccggcggacggcgcgcatccgcagccggacgccggtcacccggtccatcgcggcggccaggatgatcagtgtggcggcgccggtcaggagcatcgcggtgcggacccagccggtcatgtcgttgccggcgcaggccagggccagggcggccgccgaaccgtaggcgaaccaggcggggacccggcgcgggctgccctggcgcagggtctgccggccgcgctggtcgatctcggcaagcgccttcgcggcctcggtggcgtccatgacggcattccttcctgacgggaaaatgtttcctgtcaggaaactataggccgaatctttcctcgcaggcaagtatcgacccgtgcgccgctgcgtcgggtgcgggcgatgtcggtcgagctgacgaccgggatcccgggcggcgccaggtcgagcggccgcctagctagctaggcggcgcccaccccgccgctccgccgaagagccacccggcgcagggcgccgaccagggcccccactcctacgccccgccggcggtggctccggtgagctcggcgaccagggcgcgcatcgcgaccgccaggtcggcgccggtcgccgagctggccgggtcgatcagccactgtgccatcaccccggtcatcagcgcgtggcagaaggtgccgatggcgcggcgggtgtcgtcgtcgtcgccccggtagaacatccggccgagcccctcgcgaccctcgttgagaccggacagcagcatttcgcggacgtcggcgttgttctgcgcgtgtgcgaacacctcgaagttcgccgccagcaggccgccgtgccggccgaacaggctgacgacccgggtccaggtgagctggaaccgctcgaccgggccggcctccgggtcgggttgcgcggccagggcggcggccagttcggtgccccactcgccgagggcctcgatcagcgccaggttgagcagcacctccttggatccgaagtggtagccgatcgagccgaggttggtccctgaggcggcgacgatgtcccgggtggtggtgcggaggtaacccttcgcgtagaggcaggccttggcaccttctagcagatcttcgcgatgtcccacggaggtcagcatacagatattcatacgtccgtcacacacaagcgtactagaccgttgaataaaacatctgtatagttctgcccatgacgcagatcaagcggcaagcagggcgccgggagtggatcgcactcgccgtcctctccatccctccgctcctggtttcgatggacatcaccgtcctctacttcgcgattccgcagatcacgaatgaccttcggcccaccaccacgcagcagctgtggatgatcgacatctacggcttcctgctcgccggcatgctgatcgcgctgggtgacctcgccgaccgtcttggccggcgcacactgctgctgctgggcctcgccgtgttcggtctcgcgtcgctcggtgcctccttcgccaacagccccgagacgctgatcgtggcccgagccgtgcaggggatcggggcggccgcgctgatgcccgccggcctcgccctgctgcgcaacctcttcgaggatgacgggcagcggcggacggcgatcaccatctggtcgatcggtgtcgcctccggcgccggcatcggcccggtgatcagcggcgtgctgctgcacaacttctggtggggctcggtcttcctggtcaacgtcccgatcatcgcggtggcgctgatcctgaccgcggttctggtgcccaacttcaaggtcgcgcccggcagcatggggcgcttcgacttcttcggcgcgctgctgtcgctggtcgcggtgctggccatcatctggggtgtcaaggagggtgcgatcaacggcttccacgccaagccgctgaccgcgctgatcggtggcctggtcgccgccgcgctgttcctctaccggcagacccacctcacgcacccgatgatcgacccgaagctgttccgcaccaagggcttcaccccggtgctcgtgctcagcctcaccggcttcttctgcgtgatcggcttcggtgtcttcagcacccagtggctgatggaggtcaagggtctcggcccgctgcaggccggtctctggatgatggcgtcgccgctgctggccggcggcatcgtcccggtcgccaccggcatggtcaacaaggtccgcccggcctacctgatcaccggcggcttcgtcctggccaccatcggctacgtgatcatgtcgcaggtcaaggcggacagcccgatcctgctggtggtctccggcacggtatgcatcggtatcggtaccgcgtcgatcttcgcgctgctcaccgacatggtcatcgcggtggccccggtcgaccagacggccgcggtctcggcgctgtccaagaccatgcaggagctcggcggcgccctgggcatcgcgatcttcggcaccgtcggcgcctcggtctaccggcactacttcgacgcgcacctgccgagcggtctgccggccgacgtggtcgccggtgcccgccagacgatgggcgccgcgagcggcatcgccgcctcgctgcctgaccaggtggccaagccgctgctggaggtcgcccggatcggcttctccaactcgctggccaccacggcggtggtgggcatcgcggtggccgccggctcggcgctgctgaccgtgacccgcctgcgccacgtgcggtacacgaccgaggaggtggcggcgaaggccaccgccgagccggccgaggccgagatcgcgccggtcgcctgacagcgccgcgcaccacggtccacccttccggcgagccggcgcctgtccgaagcggattcccgctgcggatggcgccggttccgttgtgtccacagccggatagttgtttccaaaacattactgcggtttaacaccttgcggcattcgtggttagcggttccggggcgacgggaatgtcatcccctaatgaacccctaccgtgacggagtcggtgccggtcgcggggcgcgggccgggtgcgacccccgcgccggccgccggagaaaggtgaaggctgatcaccttatggccggtgctgatctgtgcaaagctcgcagaagtggcaggccgcatcggagcgtcttgcctggcagcgccgcaagatagcggttcaccgagcggctgtcatcagtctccggtgccagatcttatgaccgaaaagatcttggccaaaattagcgtcttatgtccgatccgtgacgtggggccgagcccgccccgacgcccccgacatgcgcgacgacctgccggagttccggcgctccggtgccattcccggaagatctgcggccgcgccacgccgacggattgcagacttttccgagcatcgacttaggcatatctttctttcggcttcaggtcgtccggtgggaacacccgggtccggcctgcgtgggaaagacctatgcgaacgattaattgtcaccaggtgtacttgcgggggccgacgccttggaattcatagaaatcggtaatgcgctggagcgcctgctcgccatcctggcggtggtggcgcacggactgggccggctggtgctggtcagcgggggactcggcagcggcaagagcacgctgctgcaccggttctggcgggaggccggtcagggggacgcggtcttcctgagcgcgtccggttcggtcgccgagagcggcctgcagttcggcgtcgtcgagcagttgttcgtcagcggcgacctgcccggcgacctcgccgaccgggtgctcctgcgggtcggcgaggcggccggccagagcgaggaagcgccggacccggaggcgctgaccgagatcgcccgggaatcctgcgccgcgctgctcgccctgtcccgggagcgcaccgtcgtggtgctcgtcgacgacctgcagttcgtcgaccaggcgtcccgcgaggtgctgctgttcctggcccgccggctgcgctcggctcccgtgctgttcgtcttcagtgagtggctctggccgcagcccaccctgcccgggtaccgcgccgagctgtcccggctgccgcaccgccagatgtgcctgtccgcgctgaccgagcgcaccgtcacccggatggtggagcgggagctgccggcggcggccgcggcggcggtggcgccggccatctaccggcagagcgcgggcaacccgctgctggtggcggcgctgctggacgagtaccgggcccggcccggctcgctggccgacgggctcgcctcgggccgggcgttcggccaggccgtggtcgcctccctgcggcgctggggtccctggctgctggacgtggtccaggcgctggtggtgctcggcgaccgggccaccgccgccgacgtctcccggctgtgcggggtgcgggtcggcaaggtgcagcaggtgctggagatcatgacctcggccggcctggtcgaggacggccggctgcggcacgtcgcggccagcgacgcggtactcgacagcatgccgccggaccgcctggcgcggctcaacgggcaggcggccgaggtgctgctgcaggccggggacaccgggatgcggctggccgagcacctggtcgcggccggtgcggcggagacctcctgggcggtcaccgcactgctcgacggcgccgagcgggcgctggccgcggaccgggtcgagttcgccatgcaatgcctggagctggccctgcggggcagccgggagccggagcgcaaggcggtgatcggtgccagcatcgtgcgcgcggcgtggcggatccagccgtcgctgggcgcgccctaccgggagcacctgcggaccgcggcgctgaccggcggcctgtccgacaccgacgtgttcgtggcgctgcggcaggcgctgtggcagggcgacctggagaacgcgaccgcgacgtaccaggcgctgaccggccccgggcggcactcggatccacaggtcgcggcccgtgcccggctggcctaccagtgggtgcacggccccgggcagaccctggtggccgaggccgaccagccggacccgcggaccggcgacgacctgtggagccaggccgcgcacacgctgggcaaggtctggggcgagcgggtccgcaagtcgatcacgatcagtgccgagcacgtgctgcgcagcagcccgctgggcgacaccacgatcgaggcgatcggcaccgcgctgctcgcgctgaccctgagcaaccgggccgaggaggcggcggtctggtgcgaccggctgatcgacgaggcccgccgccgcggcgcgcgcacctggcaggcggtgctgagcagcctgcgggcccggatcgcgctgcaccgcggcgagctgggcacggcggtgcggctggccgaggactcgctgcggctgatgcagccctccgactggggcatctgcgtgggcctgccgctgggcaccctggcgatggcgcagaccgcgctgggccggcacgaggaggccgaggccaccctgcaccggccggtcccggacgcgatgttcggcacccgccacggcctgtggtacctgcgcgcccgcggccaccaccacctggcctgcgaccggttgctcgcggcgctcaccgacttccaggactgcggccggctggcccgaaactgggggatggacgtgccggccctgctgccctggcgcagcgacctggccgaggcgtacctgcggctgggcgagccgggcaccgcccgcccgctggtcgaggcgcagctggagcgggccggtaccgccgacgtggcgacccgcggcatgtcgctgcgcatcctggcggcgtgcggcgaggcggactggcgggagtcgctgttgcgcgaggcggtcgaggcgctggagaagaccggggaccggcgggagctgtcccgggcgctggtcgacctgagccaggtctactacgactccggtgatctgggtcaggcccggaacctggcgcgccgggccgagcaggaggccaaggcgtgcgagatcccgctgcgggcggcgcaccgcgacgtggcctgccatgccggggcggtccgcggtgccgagccggtcgtgccgaccgccgccgccggggacgaacaggtcccggtctccggcgcggtgctcagcggtgcggagatccgggtggcccggctggccgggctcggccacaccaaccgggagatcagcaagaagctgttcctgaccgtcagcacggtcgagcagcacctgacccgggtgtaccgcaagctgggcatcaccagccgggccgagctgccggccggactggccgcgcgaggccaggagttgggcgtggccgagccgtccgagctgtacaccgccggctgaccggggcccctacccgcgtcgtacgacggcaatcgtctgttgatctgcaccgcaggtaggggcggcggcaagttaggggtccgccgctgtggtgcccgcctggattgacttgttcactgtgcgccggtcggctccgaccgaatctcctagctttggggttgcgacatggtggcgttcagcgagtcagcggtcatcgacggcgatgccgccgcgatgtggagggtgttgacggatctcccggcactgccgcagtgggatccgcacatggaggggatcggcttcgacgggccgttccaggtcggtgccgagggctggaccaagcccaagggcgcgccgaagggcaggttcaccgtcaccgccatcgagccggagcgcagctactccacccggtcgccgatgccgatgggatcgatgagcgtcaccaacacgctcgagccggtggccggtggcggcgtgaagatcacccggcagatcgaggtgcgcggcggtttctcgccgatgttcaagtggttcttcatgaagccgatgcgccgtgacctgctggcgaccttccaggcgctgggtgccgaggccggccgccgctccacggccggctgagggggaccgtgatgaccaaggctgttgtgctcggtggcgggatggccgggatgctcgcggcgagcgtgctcgccgagcgggtggaccgggtgaccatcgtggagagcgacacgttcccgggcgggccccaggcgcgccgcggactcccgcagggccaccacttccacatgttcatgggcggcggtgtggacgccctcgacgagctgctgcccggcatgagcgacgcgctgtacctggccggggcgcaccgccggcggttcggcgacgagttcctcggcgtctccggcaacggctggggtcgcccctacgacggccgggcctacgtgctggcctgcagccggccgctgctcgaccacatggtgcgcacccgggtgctggccgacgaccggatcgaggtgctcccggcgaccaaggcgatcggcctgctcggcgaccggacccgggtgaccggcgtacgggtcgagtccagcgaccgcagccgggccggcgccggcggcctcggcatcgccgccgacctggtgatcgacgcgaccgggcggacctcgcacgcccccgagtggctgaccgagctcggcgccccgcgggtgcacatggacacccaggacgccgggttcgcctacgccgggcgcacctacgaggcgccgaccggggccggcgtcgacttcccggcgatcctggtgcaggccgacgccggcaccgggcgcccgggccggggtggcggcatcctgccgaacgaggacggccgctggatcgtcgcgatgatcggcacccggggcgggcacccgccgaccgacgaggccggctacctggagtacgcccgcgggctggccgacccgctgatcggcgagctgctcgcggcggcccgcccggtcaccgagatccgcgcctaccgggggctggtcaaccagcggcgctactacgaccggctgccggtgccggagggtttcctggtggtcggcgacgcggcgatgacgctgaacccgaactacgccaccggcatgtcgatggccgcgttcggcgccctggagctgcgcgacgagctgggccggcacggcctgaccggcgacctgacccggcgggtgcagaccgcgatcggcaaggcgggctcggtgtcctggctggccgccaccaccaacgacagctggttcccgggctcggaggcgaacttcaagctgcgcggggcgaaggcgcagaagggtttcgtgcagcgctggaaccgggtggccgcggagaacgccgacgtggcccgggcgacctacgaggtggccaccttcctggcgccacgcaaggcgatgatgacgctgccgctgatgctgaccgtgatgcgcgggccgcggctgccgcagctcacgctggacgaggcgatccggtcgtaccccaatttcgcggaccccctggccaagctggacctgggcgtcggggtgcccggcgcccgctgatcgcgaccggtcgtttccggggccgataagggtggtcgccccggacggccggcccctactttgcgaccgaccgaagctgctgatgtgctgatcgaagggcgtgcctgcgtgggcgacgaggaaaagctcctaacgtatctgcggaaggccaccgccgagttgcgggacgcccgtcagcgcatcaccgaactggagtcggccggcaccgccgacgatccggtcgcgatcgtcgcgatggcgtgccgctacccgggcggggtcacctccccggaggacctcgccgacctggtgctcgacggccgggacgcggtcgccggcttccccgacgaccgcggctggaacgtggagggcgtctaccaccccgagccgggggagccgggccggacgtacacccggcagggtgccttcctgcacgacgccgcctggttcgacgccggcttcttcgggatcggcccgaacgaggcgctgctgatggacccgcagcagcggctgctgctggagatctcgtgggaggccttcgaacgggccgggatcgacccccggtcggtgcgcggcagcgcgaccggggtgttcaccggcatgatgtaccacgactatccggaggcgcacagcaccggatcggtcgcctccgggcgggtgtcgtacgtgttcgggctggagggcccgtgcgtcaccgtcgacaccgcctgctcctcctcgctggtcgccgttcaccaggcggtccagtcgctgcgcaccggggagtgccggctggcgctggccggcggggtggcggtgatggccaccatggacaccttcatcgagttcagcaagcagcgggcgctgtccgcggacggccggtgcaagccgttcgcggctgccgccgacggcaccggctggggcgagggcgccggggtgctgctgctggaacggctctccgacgcccgccgcaacggccacccggtgctcgccgtgatccgcggcgtcgccaccaaccaggacggcgccagcagcgggctgaccgccccgaacgggccgtcgcagcagcgcctgatcgccgccgcgctggccgacgccggcctgaccgcggccgacgtggacgcggtcgaggggcacggcaccggcaccgtgctgggcgacccgatcgaggcgcaggcgctgctcgccacgtacggcgcggaccggcccgcggaccgcccgctctggctcggctcgctcaagtcgaacatcgggcacacccagtcggccgccgcggtcggcggcatcatcaagatggtcatggcgatgcgccgcggcgtgctgccccgcaccctgcacgtcgacgcgccgtcacccaaggtggactggtccgccggacgggtcgagctgctcaccgaggcccgtccgtggccggcgggggagcgccgccgccgggccggggtgtcctcgttcggggtgagcggcacgaacgcgcacgtcatcctggaggacgtcgccgacgagccggcgcccgacgacacggcgccggcaccgggaatcgtcgcctggccgctgtccgcggccagcgccgacgggctgcgcggccaggccgcccggctggccgagcggctccccgacgccaccccggccgcgatcggccacgccctggccaccggccgggccgcgctgtcgcaccgcgccgtggtggtcggcgccgacctgcccgagctgctgtccggcctggccgaggtggccgccggggagcacgaggcgggggtcagccacgaccggcccgcggtggtgttcaccttccccggccagggcgcgcagtgggacggcatggcggtcgagctgatcgagaccgccccggccttcgccgcggccctggagcgctgcgccgacgcgctcgcggagttcgtcgactggaacctgctcgacgtgctgcgcggcgttcccggcgcgcccaccttcgaccgggtcgacgtggtccagccggtgctctgggcggtcatggtgtcgctcgccgagctgtggcgcgagcacggcgtcgagccggccgccgtgctcggccactcgcagggcgagatcgccgcggcctgcgtggccggcgccctgtcgctggccgacggcgcgcgcgtggtggccctgcgcagccgggtgatcgcgaccgggctggccggcaagggcggcatgctgtccgtgccgctctcccgggcggtcgccgaacagcgcatcgagcggttcgccggccggctgggcctggccgcggtcaacggccccggctcggtggtggtctgcggcgaaccgaccgccctcgacgacctggtcgccgagctcaccgaggccgggctgcaaccgaaacggatcaaggtcgactatgcgtcgcactcgcactacgtggcggagatcgaggcggaggtccgggcggcgctggccccggtgcggccccggccggcgagcgtcccgttctactccgcggtcaccggcggcctgctcgccgacaccaccgtgctcgacgccgggtactggtaccgcaacctgcgccagaccgtgcagttcgaggacgccacccgggcgctgctggacgacgggcacgcgctgttcgtcgagtgcagcgcccacccggtgctgcaggtcggcctgcaggacaccatcgccgacgcgggcgcaccggccggcaccgtggagtcactgcgccgccaggacggcgggctgcgccggttcgccggttcgctggccgccgcctgggcgcgcggtgcgacggtcgactgggcgcggttctcgcccgcggcccggcccgccgacctgcccacctacgcgttccagcgggagcggtactggatggcgccggtggccggcgccgacccggtgtcgctgggccagcagccgctgcgtcacccgctgctgggcgccgcggtcccgctgcccggcaccgacggcctggtcgccaccggccgggtgtcgctgacctcgcacgcctggctggccgaccacgacgcgctcggcgccgtgctgctgcccggcaccgcgttcgtcgagctggcgatcaacgccggcgcccaggtcggctgcggggtgctcgccgagctgaccgtgcaggccccgctggtgttgccggaccgtggtccggtggcgctgcaggtgctggtcggcgggccggacgaggacggtgcccgcccggtcgcggtgcacgcccgcgccgagggcggcgacgccccgtgggtctgccacgcggccggcctgctcaccccggacgacggtgggccggccccgggtcacccggacgacagctggccgccggccggcgcggtcgccgtcgacgtcaccggagcctacgacgggctgctcgggcgcggctacgcgtacgggccggtcttccagggcctgcgggcgctgtggcggcgcggcgacgaggtgtacgccgaggtcgccctgcccgagccggcgcacgccgacgccgcgctgttcggcctgcacccggccgccctggacgcggccctgcacgccgccctgctcacctccgacccggacggcacggtgctgccgttcgcctggaccggcgtccggctgcacgccaccggcgccaccgagctgcgggtccggctcgccccggccggcaccggctcgtcgatccacctcaccgatccggccggccggccggtgctctccgcggacggcctggtcagtcggccggtctcggccgagcagctggccgcgcccggtgcgccgcgggacgtcccgtaccggctggactggatgccgatgccggcggccgggaccgcgccgccggtccgctggcgggaggtcggcggcctcgacgagctgaccggcgacgacgatctgcccgacgtggtgctgctgcgcgcgcccgccgccgacccggccgatctgccggccgcactgcgcgagaccggcgccgcgaccctggccacgctgcgccgctggctttccgaaccggcgctggacggccgccggctggccctgctggtcgagccggacacgctgctcggcgacacggtccgcggcatgctgcgcgccgcccaggcggagcacccggacaccttcctggtgctcgaccacgacgggcgtcccgagtcgctggccgccctgccggacgcgctggccgccggcgagcccgaggtgtccatccggtccggccgcccgcacctgccgcggctggtcgccgccggtccgccggacgccgctgcgcggccggatccggcgggcacggtgctggtcaccggcggcaccggcggtctcggtgcgctggtggcacggcagttgaccaccgattgcggcgtacggcatctgctgctcaccagtcgccgaggacccgccgccccgggtgccgaggagctggtcgccgaactgaccgagcggggcgtccaggtgaccgtggccgcgtgcgacgccggcgaccgggccgcgctggccgccgtgctcgccgcggtgcccgccgagcacccgctgaccggtgtggtgcacgccgccggggtgctcgacgacggcctgatcgcggcgcagaccccggagcgactggacgcggtgctgcgcgccaaggccgacggcgcctggcatctgcacgagctcaccgccgacgccgacctggcgatgttcgtgctcttctcctccgtcgccgcgaccctgggcggcccggggcagaccacctacgcggccgccaacggcttcctcgacgcgctcgccgcgcatcgccgcgcggccgggctgccggccaccgcgatggcctggggcctgtggaccggcgccgggatgggtgaccggctgcgcgaggccgacgtgcggcggatggcggccgacggcctgcccccgctgccggtcgccgacggcctgacactgttcgccgccgcgctgcgcaccgacgccggccaccaggcgctgctgcggctggacccggtggtgctgcctagctagctagccgggctgggccgcccggagcggctcgcgctgctcgccgacgaggtgcgccggcgggccgccgccgtgctcggcttcaccgacccggccggggtcgacccgggccgggccttccgggagctcggcttcgactcgctggcctcgctgcagctgcgcaacgcgctgaacgcgctgaccgggctgcgcctgccggccaccctggtcttcgaccacccgtcctgcgccgcggtcgccgggcacctcgacgagctgctgatgggcgccgccaccgcggacgaccgcgcgggggaccgggtggcgaccgcggacggcgagccgatcgcgatcgtcgggatcggctgccggttccccggcggcgcccgtggcccggccgggctgtggcggatcgtcgacgagggcgccgacgtgatcgccggcctgcccgccgaccgtggctgggacctggacaacggttaccacccggagcccggcacgccgggccggcactacgcccgcggcggcggatacctgcacgacgcggccgagttcgacgccgagttcttcgggatcagcccggccgaggcgctcaccatggacccgcagcagcggctgctgctggaggtctcctgggaggccctggagcacgccggcatcgacccggccacgctggccggcaccgacaccggggtgttcgccggcctgatgtaccacgactacccgctgaacaccgcgaccggctcgatcgcctccggccgcctcgcctacacctacggcttcgagggcccggccgtcaccgtcgacaccgcctgctcgtcgtcgctggtcgcggtccacctcgcggtgcaggcgctgcgccgcggcgagtgcgggctggctttggccggcggcgcgaccgtgatgtcgacgaccgagaccctggtcgacttcagcatgcaggccggcctgtcgccggacgggcgctgccgctcgttcgccgccggggccgacggcaccggtttcgccgagggcgccggcctgctcgtgctggaacgcctcgccgacgcccgccgccacggccacccggtgctcgccctgatctccggcacggcgatcaaccaggacggcgcgtccaacgggctgaccgccccgaacggcctcgcccagcagcgggtgatccgcgcggcgctggccgacgcccggctcaccgcggccgacgtcgacgtggtcgaggcgcacggcaccggcaccgtcctgggcgacccgatcgaggcgaacgcgctgctcgccacgtacggccgggaccgtcccgcggaccggccggtgcgcctcggctcgatcaagtcgaacatcgggcacgcccaggcggccgccggagtggccggcgtgatcaagatggtcgaggcgctgcggcacgacacgctgccgcgcaccctgcacgccgtgcagccgtccccgcacgtcgactgggacgccggcgcgatgcggctgctcaccgagccggccgcgtggccgggtggggaccggccgcggcgcgccgcggtctcctcgttcgggatcagcggcaccaatgcccacctgatcctgaccgagccgccggccgccgcgccggcggaggcaccggtcgccgccggtgccccggtggtgccgtggctgctgtccgcccgcagcccgcaggcactgcgcgagcacgccgccgggctagctagctagcgggccggggccgccgtacccgcgcgctgcgggtctcgcacgccttccactccgcccacatggacccgatgctggacgacctgcgcgacgttgccgccggactggaggcggccgccccgcggatcccgctgctgtcgacgctcaccggacgctgggcgacggccgaggacatcaccaccgccgggtactgggcgcggcaggtccgcgagccggtccggttccacgacgcggtggtggcgctggccgcgaccggcgcccgggtggcgctcgaactcggcccggacgcggtcctcgccgggctggggccgcactgcgtaccggacagcgatctggacttcctgcccaccctgcggcgggaccgggacgaggagcgggccctggtcaccgcggtcaccgcggcacacgcccggggtgtcccgatggaccgggccgcgttgctggccgggaccggcggcgtgccggtcgacctgcccacctacccgttccagcgccggacctactggctgaccgccggggacagctccgggatcgccgcgctggccggcgcggtcgacagcggggacgacgcgttcgacgccggactgcccgcgatgatcgccgggcagagcccggcccagcggcacctgaccctggtcgacatggtccgggtgcacgccgccgcggtgctcgggcaccccgacgtggctgcggtgccgatcgaccggccgctgcaggaactgggcttcgactcgatggccgcggtgtcgctgcgccgccggctgaccgccgcgaccggcctcaccctgcccagcaccctggccttcgaccaccccacctgcgaggcggcggcccggttcctggccacccggctggccgaggagcgggaaccggacgaggcgctggcgaccgtggtgcggctggagacgctgctggccgacactaccccgaccgccgaggtcaccgcacgcctcgaggcgctgctgcggacctggaacgaccgggccgccaccggcggcgacgggctcagcgacgaggaactgttcgcccggctcgaccgggaatacgggggcgtctgatgggacaggacgagacgatgagcgacgaccgactccggggctacctgcggcgggccgtcgccgacctggacgacgccaaacgccggctgcgcgaggccgagcagagccgccacgagccgatcgcgatcgtgtcggccgcctgccggttcccgggcggggccgacacctcggaacggctctgggacctgctggccgccgggaccgatgcgatcagcgacttcccgatggaccgcggctgggacctggccgccctgtacgacccggagcccggcacgccgggtaggacctacgtccgtaccggcgggttcctgcacgacgccgccgacttcgacgccgacttcttccggatgagcccgcgcgaggcccgggagaccgacccgcagcagcggctgctgctggagaccgcgtgggaggcggtggaacgggccgggatcgcaccgaccgcgctgcggggcaccccgaccggggtgttcgccggcgtcgtctaccacgactacagcaccgacggcgggcccggcggcctggccagcgtcgcctccggccggatcgcctacctgatggacctgaccggcccggtggtcaccgtggacaccgcctgctcgtcctcgctggtcgccctgcactgggcggtgcgggcgctgcgctccggcgaatgttccctggccctggtcggcggcgccaccgtgatggccggcccggcctcgttcgtcggattcagccaggaccgcggactctccccggacggccgctgccggtcgttcgcggccgccgccgacggcaccgcctggggcgagggcgccggcatgctgctgctggaacggctcggcgacgcccgccgcaacgggcacccggtgctggccgtggtgcgcggcagcgcggtcaactcggacggcgccagcaacggcctgaccgcccccaacgggccggcccagcagcggctgatccgggccgcgctggccgacgcccggctgcgcgccgaccaggtcgacgcggtcgaggcgcacggcaccggcaccacgctgggcgacccgatcgaggccgaggcgctgctcgccacctacggccggcagcgccgcgacgggcggccactgtggctaggctcggtcaagtcgaacatcgggcacacccaggccgcggccggcgtcggcggcatcatcaagctcctcgaggcgctgcggcacgaaaccctgccaccgaccctgcacgtcgacgaaccctccgggcacgtcgactggaccaccggtgacgtccggctgctcaccgaggcggtggcctggccggccggggacaccccgcgccgggccgcggtctccgccttcgggctcagcggcaccaacgcgcacgtgatcctggaggaggcgccggccgaaccggccgccctagctagctagccggccggggccgccgtacccgcgcgctgcgggtctcgcacgccttccactccacgctgatggacccaatcctcgacgaattctcgaccacgatcgcttcgctggagtacgccgtaccggccatcccgatcgtctccacgctcaccggccgcccggccaccggggacgacctgcgctccgccgactactggacgcggcaactgcggcagcccgtccgctacgccgacgccgtccgcgccctgcacgacaccggcgtcaccatcgccgtcgagatcggccccgacggcgtgctcagcgcgatgggccccggctgcctggacccggaggccgcggtcaccttcgtgccgctgctcaaagccggccgtcccgagccggacgaactggtcggcggcctcgccacggcccacgaccacggcgccgcggtggactggcccgcattcttcgccgggaccggcgccgcccggaccgacctgcccacctaccgcttccagcgcagcccgtactggcgggacaccccggcggtcaccgccgacccgctggccccgctgcactaccgggtcgagtgggcgccggtcgacatcggtccgggcgccctgaccggccgctggctcgtcctgcacggctgggccgaccggcgcgtcaccacggtcctggacgcgctggccgcgcacggcgccgaggtcgtcgcgatcccggtctccggcctggaccgcccggcgatcgccgccctgctggccgccgccccggccgccctgccggcgccggtcggcgtgctctccctgctcgccctcgacaccaccgcgcaccgcgaccacccggagatcagccgcggcctggccgacacggtcaccctggcccaggtgctcggcgacgccggcgtcaccgcacccctgtggtgcctgacccagcacgcggtcgcggccggcgaccggcacgacgtggacgccgggcagagcgcggtctggggcctcggcgccggcctcgccctggaacgcccggacacctggggcggcctgatcgacctgccgccggtcctcggcccggccaccgccggccggctcgccgccgtgctcagcggcgccaccggcgaggaccaggtggcgctgcggccggacggcgcctacgcccgccggctcacccggcccagccccggcaccaccggcgacagctggcagccgcgcggcacggtgctggtcaccggcggcaccggcgccctcggcgggcacgtcgcccggtggctggcgaccgccggcgcggaccggatcgtgctggtcagccgccgcggcgaggccgccgacggagccaccgagctggccgccgagatcaccgcgctcggcgccgaaccggtgatcgtggccggcgacgtcgccgaccgtgacgcgctcgccgccgtcctggaccggttcccggtcgacgcggtcgtccacgcggccggtaccgcccagccgatggccccgctcgaagagctcaccctggccgggttcgcggccaccgccggcgccaagaccaccggcgccgtccacctcgacgccctgctggccgacaccccgctggacgctttcatcctgttctcctccggctccgccgtctggggcagcgccgcccaggccgcctacggcagcgccaacgcccacctggacggcattgccgccgcccgccgggcccgcggcggcgccgccgtgtcgatcggctggggctcctgggacgccggcatggtcgacgccccgatcgccgccgccatgcgccggatcggcgccccggcgatgaaccccgccctcgccgtccgggcgctcggccgggtcggcgccggcgccgacccgcaaccggtcatcgccgacatccagtgggaccggttcagccccgcctacacgctggcccggccccggccgctgctgcacgacctgcccgaagcggccgtggcgccatccgccccgacggccgccgtcgacaccctggccgcgctgtccgccgcggaccgcgccgacgccatcgaccgcctggtccgcaccgcggtggccggcctgctcggctatgccgacccggacgccgtcgacaccgaccggccgttcaccgacctcggcttcgactcggtctccgcggtcggcctgcgcacccggctcaacgagcggaccggccgcaacctgcccagcacgctggtcttcgatcacgtcaccccgggcgcgctcaccgaccacctgatcggcctgtacgccgcggacggcgcgccgccctcggccatggatcacctggcccggctggaacaggcggtggacgccgccgccccggacgacccggaccggcgcccgctggccgcccggctgcgcgccctgctcggccgcctcgacggggccgccgacgccgacgacgtcaaccagcgtctcgacggcgccacggccgacgacgtgctggccttcatcgacgccgaattcggctcctgacccctcttcggctcctgacccattaaggaagcagcaccatggcgactgacgacaaggtcctcgaatacctcaagcgggttaccgcggacctgcaccagacccggcgccaactgcaggagcgcgaggaggccgacgccgagccgatcgcgatcatcgggatggcctgtcgctacccgggcggggccgacaccccggaacaactctggggcctggtcgccggcggcaccgacgcgatcgccgcgtttcccggcgaccgcggctgggacctcggcccggacagcgccggcttcgcccgggtcggcggtttcctcgacggggccggcgacttcgaccccgcgttcttcggcatgagcccgcgcgaggccctggtcaccgacccgcagcagcggctcgtcctggagaccgcgtgggaggccttcgaacgggccggcatcgcgcccgccacggtccgcggccaagccgtcggcgtctacatcggctccggcatgcaggactacggcgccctgctcgacctgtcgccggaactcaccgaggcgttcctgggcaccgccgcgaccagcgcggtgatctccggccggctgtcgttcgtgctgggcctcgaaggcccgtcgctgaccgtcgacaccgcctgctcgtcgtcgctggtcgcgctgcatttggccggccaggcgctgcgggccggggagtgcaccctcgcgctggccggcggcgtcatggtgatggccacccccggaccgttccaggcgatgagccggcagggcggcctgtccagcgacggtaggtgcaagtccttcgccgcgggtgccgacggcacggcctggggcgagggcgcgggtgtgctgctggtcgagcggctgtccgacgcgcagcgtctcggtcacccgattcttgcggtggtacgcggttccgccgtcaactccgacggcgcgtccaacgggttgacggcgccgaacggcccgtcgcagcgtcgggtgatccgcaaggcgctggcgtcggctcgcctgtcgtcggcggatgtcgacgtggtggaggcgcacggcacggggaccgtcctcggtgacccgatcgaggcgcaggcgctgctggaaacgtatggccaggatcgtgagcggccgctgctgttggggtcgatcaagtcgaacatcgggcacacgcaggctgccgcgggtgtggcgggtgtgatcaagatggtgatggcgatgcggcacggggtcgccccgcggtccctgcacctggacgaaccgacaccccatgtggactggtcgacgggaaacatccggctgctgtcggagcctcaggagtgggtggccgacggccgtccccgccgtgccggtgtctcctcgttcgggatcagtggcaccaacgcgcacgtgatcatcgagcaggccgagaccgtcgccccgcccggcgacgatcaggggccggtcgtgctgccgctgtcggcgcgcacaccggatgcgctggccgacctcgccgagcgcctccgcggggtcgccggggacctgcggccggtggacgtggggtattcggtggctaccgggcgccaggtgttcgagcagcgtgcggcggtggtggccgggtcccggaccgagctgaccgaccggctgagcacggtgaccgcgtcgaccgcccgtgccggtgacctgggtgtcgtcttcacgggtcaggggtcgcagcgtctggggatgggtcgggagttgcatgcgcggttcgcggtgttcgcggcggcgttcgatgaggtgctcgccggattcaccgctgatgtccggaaggtcgtgtggggtgatgacgctgaggcgttgaaccggaccggttctgcccagccggctctgttcgctttcgaggtggccctgttccgactgttcgagtcctggggcatccgcccgaccgtgctcggcggccactcgatcggcgaactggcggcggcgtacgtcgccggagtgtggtccctcgaagacgcgtgtcgtctggtggaggcccgcggccggctcatgcaggcgctgcctgcgggtggggcgatggtggctctgccggtcagcgcggaccagctggttttgacgcccggcgtcggcatcgccgcactcctagctagctagcccccggcaggtggagctgcccacctacccgttccagcgcgaccgctactggttggacgccgagttccgcgccgccgacgtcgcctcggccggcatcgactccaccgaccacccgctgctcggcgccgtcgtcaccctcgccgacccggacaccgtggtcctcaccggccggctgtcgctgcccacccaccgctgggtcgccgaccacgtcatcgccggcgccgtgctgttcccgggcaccggcttcgtcgaactcgccgtccaggccggcgaccaggtcggccacgacgtggtgcaggacctgtcgctgatcgccccgctcgtcctgaccgaaaccgaccgcttccagatccgggtcgtcgtcggcgcccccgaggccggccgccgccccctgtccatctactcccgccccgagggcgcctccaccgaaccctggctgctgcacgccaccggccagctcgccgccgcctcggccaccacctcgcccggcgcctcgctcagcggcacgtggccaccggccggcgccgagccgatcgaggtgggcgaggtgtaccgggaactcgccgagggcggctacacctacggcccggccttccggaacctgcgcgccgcctggacctccggcagcgacgtgtacgcggagatcgccccggaaaacctcggcaccgaccggttcctgctgcaccccgccctgctcgacgcggccctgcacgccgtctcacacaccggggtcctgggggacagcgcggttgtcccgttctccttcaccggagtcaccctgcgtgcctccggcgcggcggcgctacgggtgcggctgtcgcacaccgggccgcgcaccctgtccatcacgatcgccgactcggccggctcaccggtggccacggtggactccctggtcatgcggccgatcagcgaggcggtggggagtgccgccgagccggtccaccagctcgtctggcagccgatcgacaacgccggcgcggccgccccgaccgccggcaccggccacgccgccgggggagccgcccaggccatcagcgccgcggcgaacgtcaccggccaggcgttgagcgcggcggcgaccgccaccggccaggcgctgagcgcggcggtgaccgccaccgcccaggccctcagcgtggccgcccaggccatcagcgccgccgcccacggcaccggccgtgccgccggaccggctgccccggccgctaccgcatctgcccacgccaccagcggtgccgtctacgccaccggacccgacggcgctcaggtcgaggtggtcgaggcgggagcgttcgacccggggccgggggccgcagtcccactgcgggtgcgtgcggtgctggccggggtgctgcggaagctgcaggagggcaccgccgtcgtcgtggtgacccggtacgcggtcgcggtcgcggacggcgatgtggtggacgtggtgcaggcgccggtgtggggtctggtgcggtcggcgcaggcggagaacctgggccggatcgtgctggtcgacaccgacggcggcgacatcgccggagccctggccagcggtgagccggaggccgccgtccgcggcgcgcgggtcttcgcgccacggctggtccgggccgcccccggcgagggcgtctcgttctcgggccgggtcctggtgaccggtggtaccggtgggctgggtgcgatcatcgcccgccacctcaccgagaatcatgagatttcggatctgctgctggtcagccggcgtggactggaggcgccgggcgcccgcgagttgcgggcggatctggagcggctcggggcaacggtgcacgtggtcgcctgcgacgtgtccgaccgggaggcggtcgcggcgctgctggccgccttcccggtcgacggcgtggtgcacacggccggcgtgctggacgacggggtgctcgacgcgatgaccccggagcgcctcgaccgggtcctcgcccccaaggcggacgccgcctggcacctgcacgagctggccggtgacctgaccgccttcgtgctgtactcctccgcctccggggtgctcggcaacccgggccaggcgaactacgcggcggccaacaatttcctcgacgggctggcccagttccggcgcgcccggggtcttccggctgtctcgctggcctgggggctgtggggctccaccggcggcatgggtggtgaactgtcggccgcggacgccacccggctcaacgccaacggcatccgcccgatcaccccggaacgcggcgtcgccctgttcgacgccgccctcgccgccggcacgccggtggccgtcccggtctcgctggacctcggcgtgatccggcggcggctcgacttcgtgcccgcgctgctgcgcaccctggtgccgagcacccgccggcggcggcccgcaaccgcgcagtcgtcgctgcggcgcaccctggccgcccttcccgagcaggaatggccggccgccgtgctgcaggtcgtccgcggtcaggtcgcgtcggctctgggctacgccaccccggccggggtggagatcggccgcgccttctccgatctgggtttcgactcgctgtccgcggtcgagttccgcaacgccctggccgcggtggtgggcatcaagctgtcgctagctagctagtccgatcgaggcgcaggcgctgctggaaacgtatggccaggatcgtgagcggcctttgctgttggggtcgatcaagtcgaacatcgggcacacgcaggctgccgcgggtgtggcgggtgtgatcaagatggtgatggcgatgcggcacggggttgccccgcgcacgctgcacctggacgagccgtctccgcacgtggactggaccgccggcaacatccagctcctgtcggaggcccaggaatgggtggtcgacggccgtccccgccgggcgggtatctcgtcgttcggcatcagtggcaccaacgcccacgtgatcatcgagcaggccgaggagtctccggtgacgccgggggctgatgatgacggtccggtggtggtgccgttgtcggcgcggacgccggaggcgcttgctgatcttgccgatcggctgggtgaggtcgcggcgagtctgcgtccggtggatctcgggttctcggtcgcgacgagccgtgcggtgttcgagcagcgcgccgccgtggtcgccacctctcgcgcctccctgggggaggccttgcgcaccgctaccgcctcgaccgctcgccccggggacctgggtgtcgtcttcacgggtcaggggtcgcagcgtctggggatgggtcgggagctgcatgcgcggttcccggtgttcgcggcggcgtttgatgaggtgctcgccggcttcaccgctgatgtccggaaggtcgtgtggggtgatgacgctgaggcgttgaaccggaccggtttcgcccagccggctctgttcctagctagctagacccgccgggtcgacctgcccacctaccccttccagcggcggcgtttctggatggactcgctcgactactggcgggaggcgtggtccggcgccgctgccggcctcggctcgggcgacgtctcctccgccggcctgaccgctcccgatcaccccctgctgggggcggtggtgaccctgcccagcaccggcggtgtcgtgctgaccggccgcctcgcggtgtccgcgcagccgtggctggccgatcatgtcgtcggcggcacgatcctgttccccggcaccggcttcgtcgaactcgccgtccgggccggtgacgaggtcgactgtccgttcgtcgaggagctgaccctgatcgcgccgctggcgctggccggtccggacgccgccgcccagctgcgggtgaccgtcatgcctaccggcgaggccggccggcaccgggtcgaggtgcactcccgggccgagcacggcgccgccgagtggcggttgcacgccgaggcggttctcgccgaccgtgccccggcagccgggttcgacctgttccagtggccgccggccggtgccgagccgctggatgtcaccggcctgtatccggcgctggccgaggccggtctgccctacggtgcggccttccgcgggctgcgcgcggcctggcggcagggcgccgatgtgctcgccgaggtcgccgtcgagggggccgagtccggccggtacgggctgcatcccgcggtcctggacgcctgcctgcacgccatcgcgctgaccgagggcagcggggagacggcgagcctgccgttcgcctggtcgggcgtgaccctgcacgcggccggagccgccgcggtacgggtccgggtcacccctaccgcccccggtgagggggtgcgcctgcaggtcgccgacgccaccggcagcccggtggccaccgtcgactcgctgaccctgcgcccggtcgacgcggccgcgatgcgcacgaccggtgtggacggtctgctacgtctcgcctggcagccggtcgtttccggcaccgccgtcccggatgacgtcgtcgttctggaggcggcacggttcgacccgggtccgggtgtcgccgttccggtacgggtgcgtgcggtgctggccggggtgctggcgaaggtgcgggagggtgatccgcttgcggtggtgacccggcatgcggtggcggtcgcggatggcgatgtggtggatgtggtgcaggcgccggtgtggggcctggtgcggtcggcgcaggcggagaatccgggtcggttcgtgttggtggacaccgatggtggtgatgtggccggggctctcgccggtggtgcggctgaggtggcggtccgtgggggcgaggtgttcgcgccgcgtctggtgcggtccggtgtcggcggtgacgggtcggtgttctcgggtcgggtcctggtgaccggcggtacgggtggtctgggtgcggtcgtcgctcgtcacctggtggatcatcacgggatcaccgacctggtgctggtgagtcgtcgtggtgtggatgccccgggtgcggctgagctgcgggctgatctggagctgctcggcgcgacggtcaacgtggtggcgtgtgacgtgtcggatcgggacgcggtcgcggcgttgctggacgagttcccggtcgacggcatcgtgcatacggcgggtgtcctcgacgatggtgtgctcggttcgatgacgccggagcgcctcgatcgggtgctggcgcccaaggcggatgccgcgtggtatctgcatgagcttgccggtgagctgtcggcgttcgtggtgttctcctcggcggcgggtgtgttcggcaatccgggtcaggcgaactatgcggcggcgaacaacttcctggatggtctggcgcagcttcggcgggcgcagggactcccggccctctcgctggcctgggggctgtggggttccgccgacagcggcatgggcggcgacctctcggccgccgacctcggccggatgcgccgcagcggtgtcgtcccgctgaccgaggcgaagggcctggccctgttcgacgccgcggtctccaccccggccccggtcctggtcccgctcggcctggatctttcgggcgccgacccgctggccgtcccggagctcatgcagggtctgctgcgccgccgaccgtcccgcaccgccgtctcggccggcgcgtcggtctggcgctcccgcctcgccgacctggacgagcccggccgcctggccctgatgagcgacctggtttgcgcgcaggccgcatcggtgctcggcttcgcctcggcggatgccgtcgacgccgggcgtgccttctccgatctgggtttcgactcgctgtccgcggtcgagttccgcaacacgctcgcggcggcggtcggcatcaagctgtccctagctagctagcccgatcgaggcgcaggcgctgttggagacctacggccaggaccggccggacgaccggccgctgctgctcggctcgatcaagtcgaacatcgggcacacgcaggctgccgcgggtgtggcgggtgtgatcaagatggtgatggcgatgcggcacggggtcgccccgcgcacgctgcacctggacgagccgtctccgcacgtggactggaccgccggcaacatccaactgttgaccgaggcccaggaatgggcggttgacggccgtccccgccgggcgggtgtctcctcgttcgggatcagtggcaccaacgcgcacgtgatcatcgagcaggccgaggagcccccggtgaccccggggaccgacgacgagagcccgattgtcgtgccgctgtcggcccgcaccccggacgctctcgccgctctcgccggccggttcgccgatctgctggaggccgaccccgcgatccgaccgctcgacctcgccttctcggtcggcaccaagcgcgcggcattcgagcagcgcaccgccctgtccggcgcggaccgcgccgggttggtggcccgggcgcgacgggcggcagggggtgcaccgacccctaccccgatccgcaagggtccggtcggggtggtgttcaccggccagggctcgcagcgtctgggcatgggccgcgagttgtacacagcgttcccggtgttcgcggcggccctcgacgaggtgctcgccggcttcaccgcggaggtgcgtgaggtgatgtggggcgacgaccccgcacccctgcacgagaccggtttcgcccagcccgccctgttcgctttcgaggtggccctgttccgtctgttcgagtcctggggcgtacgccccggggtggtcggcgggcattcgatcggcgagctggcggcggcctacgtcgcgggcgtgtggtcgctcgaagacgcgtgtcgtctggtggaggcccggggccgtctgatgcaggcgctgccggcgggtggggcgatggtggccctgccggtgagcgcggaccgggtcgctctgacggccggtgtcggcatcgccgcgctgaacgggcccgcgtccacggtgatctcgggtgtcgaggccgaggtgctggcgatcgccgagcagttcccgaacgcacgccggctcaaggtgtcgcatgccttccactcaccgttgatggagccgatgctggccgagttcgccgccgtcgccgccggcctcacctacgcgaagccggcgtatccggtgctcgccgcgggtgacgtgacggatccggcgttctgggtcgcccatgtccgcgatgcggtgcgtttcaccgacaccgtcgccggtttggtcgagcgcggcgtcggcacggtcctggagatcggcccagacgcgacgctgacgacgttgatcggttacaacaccgacgagctggcgacgatcgccgcccagcagcgggacaccggcgaactgctcgccaccgccaccgccgccggccgcctgttcgagaccggcgccgcgatcgactggaccgccttctacgccggccgcgacgcccgcgcggtcgagctgccgacctacccgttccagcggcagcgcttctggctggacgccctcgactactggaaagaggcgtggtccggcgccgccgccggcctcggctcgggcgacgtgtcgtcggccggcctgaccgctcccgatcacccgctgctgggcgccgtggtggtcctgccggacgacgagggcgtcgtgctgaccggccgcctggcggtgtccgcgcagccgtggctggccgatcatgtggtcggtggcacgatcctgttccccggcaccggcttcgtcgaactcgccgtccgggccggtgacgaggtcggctgcccgacggtcgaagagctcaccctcgtcgcgccgctggcgctgaccggcccggacgccggcgcccagctgcgggtggtggtctcgcccgccgacgcctccggccgccgccgggtccgggtgcactcccgcccggagcacagcgccggcgagtggcagctgcacgccgaggcgaccctcaccgaggagaccgctcccgccgggttcgacctgctgcagtggccgccgaccggcgccgaaccggtcgacctgaccggcggttacccggccctggcggaggccggctacggctacggtccggcgttccaggggttgcgtgccgcctggcgccggggcgacgagatcttcgccgaggtcgcgaccgacgaggccgacgccgaccggtacacgctgcacccggccctgctggacgccgcgctgcacgcggtgctgctcacccacgcggacggcgacggtgacggccgaatcgtgctgccgttcgcctggtcgggcgtgcaagcgttcgccgacggcggcccggcgacgatccgggtccggatctccccggccgggaccggcgacgatctcaccatccgggtcgccgaccgggccgggcggccgatgctgaccgttgcggcgctgacctcccgtccggtcgatccggcggcgatgcgagccgccgacgtggacggcctgctgcgcctgtcgtggcaggcggtcgcacccggcaccgcggtcgctgaggacatcgtcgtgctggaggcggcgcggttcgaccccggtccgggtgtcgccgtcccggtacgggttcgcgcggttctcgacgcggtcctggcgaggcttcaggagggtgagccgtcggtggtggtgacccggcatgcggtcgcggtcgcggacggtgatgtggtggatgtggtgcaggcgccggtgtggggtctggtgcggtcggcgcaggcggagaatccgggtcggttcgtgctggtggacaccgatggtggtgatgtcgccgcggccttggccggtggcgaggctgaggtggcgattcgtgggagcgagctgttcgcgccacggttggtgcggtccaccgtcaccgccggtgggccggctttcgcgggtcgggtcctggtgaccggtggtaccggcggtctgggtgcggtcgtcgcccgtcacctggtcgatcagcacgggatcgtcgacctgctgctggtgagccggcgcggcccggacgccccgggggcggctgagctgcggactgacctggagcggctcggcgcgacggtcaacgtggtcgcctgcgacgtctcggatcgggacgcggtcgccgggctcctggaggagttcccggtcgacggtgtggtgcacacggccggtgtgctggatgacggtgtgctcgcctcgatgacacccgaacggctcgacagggtgctggcgcccaaggcggatgccgcgtggcatctgcatgagcttgccggtgagctgtcggcgttcgtggtgttctcctcggcggcgggtgtgttcggcaatccgggtcaggcgaactatgcggcggcgaacaacttcctggatggtctggcgcagctccggcgggcccagggtctgccggcggtgtcgatggcctgggggctgtggggttcgaccggtggtgggatgggcggggagttgtccccggccgacgtcgcgcggatgcgccgcggtggtgtcgtcccgctgaccggggccaagggcctggccctgttcgacgccgcggtctccactccggccccggtcctggtgccactcggcctggacctcgacggcgccgacccgcagctggtgccgccgctgctgcagggcctgctgcgccgccgcccggcccgctcggcgggtgcggccggcaccccggacggcgccgagtggcgggcccggctcgccggcctggaccggcccgaccggctcgccctgctgctcaccctggtccgcggtcaggccgcgacggtgctcggcttcgcctcggcggatgccgtcgacgccggtcgggccttctccgacctgggcttcgactcgctgtccgcggtcgagttccgcaacgccctcacggcggcggccggcatccgcctgtcgccgaccctgatcttcgactatccgacccccgcggccctggccgagcacctgctcagccacttcgccgacggcccggagacggacggcggcgaggccgaggtgcggcaggtgctgcgggacatcccgctcagccggctgcgcgacgccggcctgttggacgccctgctcgaactgggcggcgtccgcgtcgccgcggcggagagcccggagccggcggaaaccctgtccatcgacgagatggacaccgaaagcctgatctctcgggcactcgaagactttgacttcggcgacacgacgcagggagcgtgagaacggtaatgcccagttctgaggaaaagcttgtcgaagccctccgagcgtcgctgaaggaagcggaccgcctgcgtggccagaaccgcaaactgaccgccgccagccaggaacccatcgccatcgtcggcatggcctgccggtatccgggcggcgtggtctcccccgaaggcctgtgggacctggtcgccgacggcgttgacggcgtctccgagttcccgaccggccggggctggggcaccgacatcttcgacccggtcccgggcgcggccggcaagtcctacgtccgtgagggtggtttcctgcacgacgcggatctgttcgatccgggcttcttcgggatctcgccgaacgaggcgctcgtgatggatccgcagcagcggctgctgctcgaagtgtcgtgggaggtgttcgagcgggcgggcatcgacccggtgtcgctgcgcggctccgataccggcgtgttcgtcggcatgatgtaccacgactacgccgccaactcgtccacgggcgcggtcgcctcgggccggttgtcctatgtgctcgggctggaagggccgtcgatgacggtcgacaccgcgtgctcgtcctctctcgtctcgctgcatctcgcggcgcaggcgttgcgggcgggggagtgttcgctggcggtcgtgggtggtgtcgccgtgatggccacgcctgaggtgttcgtggagttctcccgtcagcgtgggctctctcctgatgggcgttgcaagtctttcgccgcgggtgctgacggcaccgcgtggggcgagggcgcgggtgtgctgctggtcgagcgtttgtcggatgcgaagcgtctcggtcatcggattcttgcggtggtacggggttcggcggtgaatcaggatggcgcgtcgaacgggttgacggcgccgaacgggccgtcgcagcgtcgggtgatccgtaaggcgctggcgtcggctcgcctgtcgtcggcggatgtcgacgtggtcgaagcccacggcaccggcaccgtgctgggcgacccgatcgaggcgcaagccctgctggaaacctacggtcaggatcgtgagcggccgctgctgctcggctcgatcaagtcgaacatcgggcacacgcaggctgccgcgggtgtggcgagtgtgatcaagatggtgatggcgatgcggcacggggtcgccccgcgcacgctgcacctggacgagccgtccccgcacgtggactggaccgccggcaacatccaactgttgaccgaagccgaggagtgggtggtcgacggccgtcctcgccgggcgggtatctcgtcgttcgggatcagtggcaccaacgcgcacgtgatcatcgagcaggccgaggagcccccggcggcctcggggaccgacgacgagagcccgattgtcgtgccgctgtcggcccgcacgccggaagcacttgccgacctggccgaccggctgagccgggccgccgcggatctgcgtccggtcgacgtcggcttcacggtggccaccggccgctcggtgttcgagcagcgtgccgctgtcgtggccggcaccggtgccgagctgaccgccgccctgagtacggtgaccgcgtcgaccgcccgtgccggtgacctgggtgtcgtcttcacgggtcaggggtcgcagcgtctggggatgggtcgggagctgcacgcgaggttccccgtgttcgcggcggcgttcgatgaggtgctcgccggcttcaccgctgatgtccggaagatcgtgtggggtgatgacgctgaggcgttgaaccggaccggttctgcccagccggctctgttcgctttcgaggtggccctgttccgactgttcgagtcctggggcatccgcccgaccgtgctcggcggccactcgatcggcgaactggcggcggcgtatgtcgccggggtgtggtccctcgaagacgcgtgtcgtctggtggaggcccgcggccggctcatgcaggcgctgcctgcgggtggggcgatggtggctgtgccggtcagcgctgatcagctggttttgacgcccggcgtcggcatcgccgcgctgaacgggcccgctagctagctaggcccgccgggtcgacctgcccacctacccgttccagcgcaggtcgttctggctggaggtcaccgaatacctcgccgagtcctggctcgctcaggagttcggcggcttgcgctcgaccggcctggtcgcttccggtcacccgatggtgggtgcggtcgtcaccgccccggacggcccgcgcgtggtgctgagcgggcggctgtcgctggccgcccagccgtggctggccgaccacgcggtcggcggcaccgtcctggtccccggcaccggtctgctggagctggcgctgaccgccggccgccaggtcgacctgcccgtggtggacgagctgaccctgatggccccgctgctgatcccgccggccgacggcgtggtggtgcaggtcgtcgtcgacgacccggacgccgccggccgccgggccgtcgcggtgtactcccgggtcgaggacgccgccgacgaccagccgtggacgctgcacgcccagggcacggtcagcgacgagctcggcggcgaccgctgggacgcgctgcaatggcccccggccggcgccgaaccggtcgacctgaccggcggttacccggccctggccgaggccggctacggttacggcccggcgttccaggggctgcgggccgcctggcgccggggcgacgacatcttcgccgaggtcgccaccgacgaggccgacgccgaccggtacacgctgcacccggccctgctggacgcggccctgcacgcggtgctgctcacccgcgacggcgacggtgacggccggatcgtgctgccgttcgcctggtcggaggtcagcgtccacgccggcaccggcccgtcctcgatccgggtccggatctccccggccgggaccggcgacgacctcaccatccgggtcgccgaccaggccggccgcgcgatcctgacggtcgccgcgctgacctcgcgtccggtcgatccggcggcgatgcgcgccaccgacatggacggcctgctgcacctcgcgtgggaccggatcgaggcgggtaccgcggcccccggcgaccacgaggtcgtgatggcggccgctttcgacccgggtaccgggacgccggtcccggagcgggtgcgtgcggtgctggccggggtgctggcgaagctgcaggagggcacctccctcgcggtggtgacccgtaacgcggtcgcggtcgcggacggcgatccggtcgatgtcgtgcaggcgccggtatggggcctggtgcggtcggcgcaggccgagaacccgggtcggttcgtgctggtggacaccgacggtggtgacgtcgccggggctctcgccggtggtgcggccgaggtcgcgatccgtggaaacgagctgttcgcgccacggctggtgcgggcgagtgtggccgacagcccggtgttcaccggccgggtgctggtgaccggcggcacgggtggtctgggggcggtcgtcgcccgccacctgatcaccggttacgccgtacgggacctggtgctggtgagtcgtcgtggtgtggatgccccgggtgcggctgagctgcgggctgatctggagctgctcggcgcggcggtcaacgtggtggcgtgtgacgtgtcggatcgggacgcggtcgcggcgttgctgggcgagttcccggtcgacggcatcgtgcatacggcgggtgtcctcgacgatggtgtgctcggttcgatgacgccggagcgcctcgatcgggtgctggcgcccaaggcggatgccgcgtggtatctgcatgagcttgccggtgagctgtcggcgttcgtggtgttctcctcggcggcgggtgtgttcggcaatccgggtcaggcgaactatgcggcggcgaacaacttcctggatggtctggcgcagctccggcgggcgctgggactgccggcggtgtcgatggcctgggggctgtggggttcgaccggtggtgggatgggcggggagttgtccccggccgacgtcgcgcggatgcgccgcggtggtgtcgtccccctgaccggggacaagggcctggccctgttcgacgcggcggccgccgcgcccgtcgtcatcccgatgggcctggacctgaccggggccgacccgctgctcgtgccgccgctgctgcagggtctgctgcgccgacgaccgtcccgcaccgccgtctcggccggcgcgtcggtctggcgctcccgcctcgccgacctggacgagcccggccgcctggccctgatgagcgacctggttcgcgcgcaggccgcatcggtgctcggcttcgcctcggcggatgccgtcgacgccggacgtgccttctccgatctgggtttcgactcgctgtccgcggtcgagttccgcaacgccctggccgcggtggtgggcatcaagctgtccccgacgctgatcttcgactacccgacgccggccgtgctggccgaattcctgctcgccgagctgaccggtgccggcgaggatgtgatcacctcgacggtcgtggccgacgacgacccgatcgtgatcgtgggcatggcctgccgctatccgggcggcgtggtctcccccgaaggcctgtggaacctggtcgccgacggcgtcgacggtgtgacggagttcccgaccggccgtggttggggcagtgacgtcttcgacccgaacccggggacgccgggcaagtcgtacgtccgtgagggcggtttcctgcacgacgcggacctgttcgatccgggcttcttcgggatctcgccgaatgaggcgctgatcatggatccgcagcagcggctgctgctcgaagtgtcgtgggaggtgttcgagcgggcgggcatcgacccggtgtcgctgcgcggctccgataccggtgtgttcgtcggcatgatgtatcacgactacgccgccaactcgtccacgggctagctagctagggcctcgggccggttgtcctatgtgctcggtttggaagggccgtcgatgacggtcgacaccgcctgctcgtcctctctcgtctcgctgcaccttgcggcgcaggcgctgcgggcgggggagtgttcgctggcggttgtcggcggggttgcggtgatggcgacgcctgaggtgttcgtcgagttttcgcggcagggtggtttgtcgcgtgacggtcgttgcaagtctttcgccgcgggtgctgacggcaccgcgtggggcgagggtgccggggttttgctggtggagcgtttgtcggacgccaagcgtctcggtcatcagattcttgcggtggtacggggttcggcggtgaaccaggatggcgcgtcgaacgggttgacggcgccgaacgggccgtcgcagcgtcgggtgatccgtagggcgctggcgtcggcgggcctttccaccgcggacgtcgacgtggtcgaagcccacggcaccggcaccgtgctgggcgatccgatcgaggcgcaggcgctgctggaaacgtatggccaggatcgtgagcggcctttgctgttggggtcgatcaagtcgaacatcgggcacacgcaggctgccgcgggtgtggcgggtgtgatcaagatggtgatggcgatgcggcacggggttgccccgcgcacgctgcacctggacgagccgtccccgcacgtggactggaccgccggcaacatccaactgttgaccgaagcccaggagtgggtggtcgacggccgtccccgccgggcgggtatctcgtcgttcgggatcagtggcaccaacgcccacgtgatcatcgagcacgttgacgagccctcggtgacgccgggggctgatgacgacggtccggtggtggtgccgctgtcggcgcggacgccggaagcgcttgccgatcttgccgatcggctgggtgaggtcgcggcgagtctgcgtccggtggatctcgggttctcggtcgcgacgagccgtacggtgttcgagcagcgcgccgccgtggtcgccacctcgcgtgaaggattgcgcgcaggcctccaggctgtgaccgcatccgttccgcgttccggcagcctgggtgtcgtcttcacgggtcaggggtcgcagcgtctggggatgggtcgggagctgcatgcgcggttcccggtgttcgcggcggcgtttgatgaggtgctcgccggcttcaccgtggacatccggcaggtcgtctggggcggtgacgccgcgacgctgagccagaccggtttcgcccagccggctctgtttctagctagctagcccaccgggccgacctgcccacctaccccttccagcgcaggtcgttctggctggaggtgaccgactatctcgccgagtcctggctggctgaggagatcggcggactgcgttccaccggcatgaccgcttccggtcacccgatgatcggcgcggtgctgtccgcggccgacagcacccgggtcgtgctcaccggccggttgtccctgaactcgctgccctggctggccgatcacgcggtcggcggcaccgtcctggtccccggcaccggtctgctggagctggcactgaccgccggccggcacgtcgactgcccggtggtggacgagctgaccctgatggccccgctgctgatcccgccggccgacggcgtggtggtgcaggtcgtcgtcgacgacccggacgccgccggccggcgcgccgtgtcgatctattcgcaggacggcgaccggccctgggtgcggcatgcccagggcacgctgagcgccgacgccggagcagagcgctgggatgtgctgcagtggcccccggccggtgccgaaccggtcgacctgaccggcggttacccggccctggccgatctcggctacggctacggcccggtcttccaggggctgcgcgccgcctggcggcagggcgacgagatcttcgccgaggtggccttcgacgaggtggacgccgaccggtacacgctgcacccggccctgctggacgcctcgctgcacgcggtgctgctgacccacgacggcagcgccggcgacggccggatcgtgctgccgttcgcctggtcgacggtgagcgccttcggcgacccgggcaccgggccgaaggcgatccgggtgcggatctcgccggtcggggacagcggtgacatcaccgtccgggtcgccgaccagaccggccgggcggtcctgaccgtctcggcgctcacctcccgcccggtggacccggccgcgatgcgcgccgcggacagcgcccacctcctcgaggtcgcctggcagccggtcgaggccggcacggcggccgccgaggacgtcgtcgtgctggaggcggccgccttcgacccgggcccgggcatcccggtgccggtgcgggtccgcgccgtcctcgacgcggtcctcgcccggctgcaggagggcgccgcgctcgcggtggtcacccggcacgcggtcgcggtggccgacggcgatgtggtggacgtcgtgcagagcccggtgtggggcctggtccgggccgcccaggcggagaacccggggcggatcgttctgatcgacagtgacggtggggatgtctccggcgcgctcggcgcgggggagccggaggtcgcggtccgcggtggtgtgctgtcggtgcctcggctggtgcgttcgtccgggggcggcggcggtgtctcgttcaccggccgggttctggtgaccggtgggacgggtggtctgggtgcggtcatcgcccgccatctcgtcgagaatctcgatgttcgcgagttgttgctcgtcagtcgtcgtggtcgggatgctccgggtgccggtgatctcaaagcggatctggaggggctcggcgcgacggtgaatgtggtcgcgtgtgacgtgtcggaccgtgacgaggtggcggcgttgttggcggcgttcccggtcgacggtgtggtgcatgcggctggtgtggcggacaacggggtgatcggctcgatgaccccggagcgtttcgaccgggttctggcgccgaaggccgacgcggcgtggcacctgcacgagctggccggggatctgacggcgttcgtgatgttctcctcggccggtggcatggtcctcgcggccgggcaggccccgtacgcggcggccaacaacttcctcgacggtctcgcccacctgcgccacgcccggggcctgccggcggtgtcgatggcgttcggcctgtgggcggtcgacgccggcctgagcgcgttcctgcaggaggccgacttcgagcggctgcgccgccagggcctgcccccgctcaccgagcaggagggcctggccgccttcgacgccgcgctcaccgccggggccgccctggtcgtgccgctgaaggtcgacccggccgtcccggcacgcggcgacgacaccccggcgctgctgcgctcgctgatgaaaccggcgtcgtcccgggcccgccgggccggtggcagccaggtgctgctgcgccagctcgccgggctcggcgccgccgaccgggccgccgccctgctcgacctcgtccgcaaccaggtcgccgcggtgctcgggcacagctcgccggccgtggtcgagccggaccgcgccttccaggagctcggcttcgactcgctctccgcggtcgagctgcgcaacgtgctcaacgaggtcaccggtctgcgactgccggccaccctcgtcttcgactacccgtcggccaccgcggtcgccggctacctcgacacccagctgaccggcgccggagccgacgccgcgccgccggtgaccaccacccgccgggccgacgacgagccgatcgcgatcgtggcgatggcctgccgctaccccggcgacgtgaccacccccgaggaactgtggcggctggtccacgacgggatcgacacggtctccgacttcccggacaaccggggctgggacaccgcccggatctacgacccggagcccggcaagttcggcaggacgtactccaaggagggcgcgttcctgcacgacgcggccatgttcgacccggcgttcttcgggatcagcccgaacgaggcgatcgccatggacccgcagcagcggctgctcctggagcttgcctgggaggccgcggaacgcgccgggatcgacccggtcaccctgcgcggcagctccaccggggtgttcgccgggctgatgtaccacgactacgggcagggctcggaccgcgcctcgtccagcggcggcagcctggtctccggccggatcgcctacaccctggggctggagggcccggccgtcacggtcgacaccgcgtgctcgtcgtcgctggtggcgctgcactgggcggtacaggcgctgcgctccggcgagtgctcgctcgccctggccggcggtgtcacggtgatgtccacgccggccatgttcgtcgacttcagccggcagcgcgggctgtcgccggccgggcggtgcaagtcgttcgcggccggcgcggacggcaccggctggggcgagggcgccggcctgctgctggtcgagcggctctccgacgcgcggcggctgggccacccggtgctcgccgtggtcaaggccaccgcgctcaaccaggacggcgccagcaacggcttcagcgcccccaacgggccgtcccagcagcggctgatccggcaggcgctgtcggtggccggcctcggcacggccgacgtcgacgtggtcgagggacacggcaccggcaccgtgctgggcgacccgatcgaggcgcaggcgctgctggagacctacggccgggaccggccggacgaccggccgctgctgctcggctcgatcaagtcgaacatcgggcacacccaggccgcggccggcgtggccggggtgatcaagatggtgatggcgatgcggcacggggtggtgccccgcacgctgcacgtcgaccagccgtccccgcacgtcgactggaccaccggcaacatccggctggccaccgaaacccgggactggcccgcggtggaccggccgcggcgcgccgcggtgtcctcgttcgggatcagcggcaccaacgcgcacgtcatcgtcgagcacgccgaggaccccgcgccgcgccgggagccggtgaccgtgcagggctccgccctggtctggccgctgtcggcgcgcaccccggaggcgctgaccgcgctggccgggcggctggtgcggctgctggaggcggacccgggcctgcgcgccgtggacgtcggctactcgctgggcgggcgcccggtgttcgagcaccgcgcggcgatcaccggcggctaccgctccgagctgctgtcccgggcgcggaaggtgacaccggtcgcggcccgtcccggggcggtcggggtggtcttcaccggtcaggggtcgcagcggccgggcatgggccgcgagctgtacgcggcgttcccggtgttcgcggcggcgttcgacgaggtgctcgccggattcaccgtggacatccggcaggtcgtctggggcggtgacgccgcgacgctgagccagaccgggttcgcccagccggctctgttcgctttcgaggtggccctgttccgtctgttcgagtcgtggggcatccgcccgaccgtgctcggcggccactcggtcggcgaactggcggcggcgtatgtcgccggggtgtggtccctcgacgacgcgtgtcgtctggtggaggcccgcggccggctcatgcaggcgctgcctgcgggtggggcgatggtggctgtgccggtcagcgctgatcagctggttttgacgcccggcgtgggcattgctgctttgaacggccccacgtccacggtgatctcgggtgtcgaggccgaggtgctggcgatcgccgagcagttcccgaacgcacgccggctcaaggtgtcgcatgccttccactcgccgctgatggaaccgatgctggcggagttcgctgagatcgcgggcggcgtgacgtacaacaatccgcgttttccgatcttgacctctggcgacgtcaccgatccggcgttctgggtcgcccacgtccgcgacgccgtgcgtttcaccgacaccgtcgccggcctggtcgagcgcggcgtcggcacggtcctggagatcggccccgactccaccctgtccacgctgatcggcctgaacaccgccgccctgacgaccgttcccggccagcagcgcgacgccgacgaggcggacgccgcggtcgccgccgtcgcccggctgttcgagaccggcacccgggtcgactggaccgcgttctacgccggccgcggcgccctccgcaccgaactgcccacctacccgttccagcgcgacgagtactggcccggcgagcaactcctgctcaccccggacgcgaccagcatcggcgtggacaccatggagcacccgctgctcggcgcggcggtgccgctggccgactcggacagcttcctgctgaccggccggatcgcccggcagtcccagcgctggctcaccgaccaccaggtcttcgacagcgtgctgctgcccggcaccgggttcgtcgagatcgccgtgcaggccggcgagcaggccggctgcgacctggtcgaggagctgaccctgatcgcgccgctggtcatgccggactccggcgcggtgctgcaggcccgggtcagcgcgccggacgagaccggccggcggaccgtcaccgtccactcgcgggcgcaggacgcggccccggacagccggtggacgctgcacgccgaaggggtgctcggccacggcgacggcgcgctcccggacgatgtcgcggtgtggccgccggccggagccaccccgatcgacctggacggcggctacgacctgctggccgaccggggctacggctacgggccggccttccaggggctgcgggccgcctggcagctcggcgacgacctgtacgccgaggtggaactgcccgaaccggtccgggccgaggcggccttctacggactgcatccggcgctgctcgacgcgaccatgcacgtcctgaacttcgcgggcggcgagggcgctcccgaggggcaggcgatgatcccgttctcctggtccggggtcaccctgcacgccaccgggagcaccgcggtccgggtcgcgctgatccggcaggacccggcctcgctcaccatgcggatcagcgatccggccggggcgccggtcgccacggtggccgggctgaatctgcgtccggtcgcggtcgagcaactgcggccggggggacgcgcggacgcgctgtaccggctggactgggtgggtcggaaggcggccggtggcacgctgcccgcgtacgccgacatccgcctggaaccgaccgtcggtgacgtgcccgcggccgtacgccgcaacaccgccctggtcctcgaccgggtgcaggcgttcctggcggacgaatcgcgggccgggacggtgctggccgtggtgacccggcacgcgttcgcggtggccgacggtgacccggtggacatcgcgcacacgccggtgtggggtctcgtgcggtcggcgcaggccgagaacccggggcggatcgtgctggtcgacagcgacggtggggatgtctccgcagcgcttgcgagcggcgagccggagatcgcggtgcgtggcggtgagctgtcggtgccccggctggtgcgttcgtccgggggcggcggcggtgtctcgttcaccggccgggttctggtgaccggcgggacgggtggtctgggcgcggtcatcgcccgccatctagtggaaaaacatgaaatctcggacctggtgctcgtcagtcgtcgcggtctggacgccccggaagctctcccgttgcgtgctgacctgcagcggctcggtgcgaccgtgaatgtggtcgcgtgtgacgtgtccgagcgtgacgaggtggcggcgttgttggcggcgttcccggtcgacggtgtggtgcatgcggccggggtggcggacaacggggtgatcggctcgatgaccccggagcgtttcgaccgggttctggcgccgaaggccgacgcggcgtggcacctgcacgagctggccggggatctgacggcgttcgtgatgttctcctcggccggtggcatggtcctcgcggccgggcaggccccgtacgcggcggccaacaacttcctcgacggtctcgcccacctgcgccacgcccggggcctgccggcggtgtcgatggccttcggcctctgggcggtcgacaccggcctcagcgcctacctccaggactccgacctggaacggctgcgccgccagggcctgcccccgctcaccgagcaggaagccctggccgccttcgacgccggcctcaccgagggccaccccctggtcgccccgctgcgcgtcgaccaggcggcgctgcggtcccgggtcggcgacctgccgcccctgctgcgcggcctggtcccggtcacccgccgccgggccgccaccggcgccgctagctagctaggacgccgccaagctccgcgcccggttcgccggcctggacgccacggcgcaggaggcggagctgcgcgacctggtgctcggcttcgccgccaccctgctcggccacgccgacccggccgcgctcgacccggaacgcgacttcctggaggccggcttcgactcgctgaccgccatggacctgcgcaaccacctgaacgcggcgaccgggctcgacctgccgccgatggtcatcttcgacaacaagagcccggcccggctggccgcctggctgcgcgccgaactcgccgtggacacgaccgcggcggagaccggcggggacacgctcagcgcgctgttccggtccggtctggaggccggggcggtgggggaggcgtacgacctgctccgctcggtggtccggctccggccgcggttccgcaccgtggacgaggtcggcgacctggcgcccgcggtcaccctgcgggagagcgactcggagctgccccggctgatctgcctgagcaccccgatggccaccggcggcatgcaccagcactcccgggtggtcgcacacctgggttcgccgcggcacgtggtcgccatcccgacccccggtttcgtggccggcgaacgcctgcccgcctcggtggacgtggccgtgcaggcgctcgccgagcaggtgctgcgggccgccgacgggcacccgttcctgctgctcggctactcctcgggcggctccctcgcctacgcggtggccggctacctggaggagcgcggcatcgagccggccggcgtggtcatgctcgactcgttccgggtcgaggacgaggcggccggcgccaccatgccgatccgcgaactgaccctgcggctgtacgaccaggagtcgctgttcggccgcttcgacagcgcccggctgtccgcgatggcctgctggttcgacctggtgccgcagctgccggtgcggccggtacgggcgcagaccctgttcgtccggtgcacccagagcttcctggagctcgaggagggccagcgggactgggaggccgagccgctcgggcccggccagaccctggtgccactcgccgcgaaccacttctcgatcatcgccgagcggtccgacgcgaccgccgaggtgatcgaccggtggctcaccgcgcacgccctctgacagcaccccttccttcacagaaaggccggccggtggccacttccgtcgaccagatcgttgacgcgctgcgcaagcagatgcgcgagaacgagaccctccgccagcagaacggcagcctgaacgcggcgctggccgcggccgccgagccgatcgccatcgtctccatggcgtgccgctacccgggcgccgtgacctcccccgacgagctgtggaagctggtcgccgacggcaccgacgcggtgtcggcgttcccgtccgaccgcggctggcccaccgacgtctacgacccgcaggagggccggcccggccgcagcgtcgcccgcgagggcggcttcctgccccgcgccaccgacttcgacgccgacttcttcggaatcagcccgcgcgaggcgctgaccatggatccgcagcagcggatcctgctcgaatgcgcctgggaggcgatcgagaacgccggcgtcgacccgcgctcgctgcgcggcaccccgaccggcgtctgggccggcgtgatgtatcacgactacgggttcgggaccagcgacggcagcatcgtcagtggccgggtcgcgtactgcctggggctggagggcccggccgtcaccgtcgacacggcctgttcctcctcgctggtggcgctgcactccgcggtccaggcgctgcgcgccggcgactgcacgctggccctggccggtggtgtcacggtgatggccaacccggacatgttcgtctacttcagcacccagcgcggcctcgcccgagacggccggtgcaagtcgttctcggcgcgggcggacggcaccggctgctccgagggcgccggcctgctgctgctcgaacgactctccgacgcccgccgcaacggacacccggtgctggccgtggtgcgcggcagcgcggtcaactccgacggcgcgtccagcggcctgaccaccccgaacggccggtcccagcagcgggtgatccggcgggcggtggccgacgccggcctcaccctggccgacatcgacgcggtcgaggcacacggcaccggcacccgactcggcgacccgatcgaggcgcaggcgctgctcgccacctacggccgggagcgggcgccgggcggcgcgccgctgctgctcggctcgctcaagtcgaacctcgggcacacccaggccgcggccggggtcggcgggatcatcaagatggtccaggccctgcgccacgaggaactgccgatctcgcggtacgccgacgaccccaccccgcacgtcgactggaccgccggcgcggtcgagctgctcaccgccaaccggccctggccgcgcggcgagcgggtccgccgcgccggcgtgtcgtcgttcgggctgagcggcaccaacgcccacgtcatcctggaggaggcgcccgacgcgccggcccccgccccggcaccggcgtcgggacactggccgctcgccctgtccgggaccaccccggctagctagctagcgctggccaccggccggaccgcgttcgcctgccgggccgtggtgctggccaccgaccgggcacaggcggtcaccgcgctggacgcggtggccgccggcgagccgcacccggacgtgctgaccggcaccgtcccggccggcgccccgccgcgcgccgggttcctgttcaccggccagggctcgcaacggcacgggatgggccgcgaactctacgacgccttccccggcttcgccaccgcgtacgacgccgtgctcgccgaactcgacccgcacctgggccggccgctacgggacatcgggccggacctgctcgacaccaccgaatacgcccagcccgcgctgttcgccttcgaggtggcgctggcccggctggtcgagtcgtgcggggtccgtcccgccgtgctcggcggccactcgatcggtgagatcagcgccgcccacctggccggggtgctgccgctcgccgacgcctgccggctggtcgccgcccgcggccggctgatccagcagctgccgtccggcggcgcgatggtcgccgtggccgcctccgaggacgaggtgacgccgctgctcaccgcggacaccgggatcgccgcggtgaacgggccggccgcggtggtggtctccggcgacgccggcacggtgctcggcatcgccgcgcggttcccccgcaccacccggctgcgcacctcgcacgccttccactcaccgctgatggacccggcgctgcccgcgttccagcagatcgccacgaccatgtcgtacgccgttccggacacccgcatcgtctcgatgaccaccggccggcgggccgaggccggcgtgatcgacacgcccgggcactgggtgcggcacgtccgggaaccggtccgcttcctcgacggggtccgggcgatggccgccgagggcgccgcgctgctgctggagctgggcccggacgcggtgctgtcgccgctcgccgagaccgcgctgccggacctggtcgcctgcccggccagccggcgtgaccagccggaagtgcgcaccctgctggccgcgctggccaccgcgtacgtcaccgggatcacggtggactgggcggccctgcacgccggctcggatgtggtccgggtgccgctgccgacctacgcgttccagcgccgccggttctggtccgaggcccaggtgtggcccgccccggaaccggccgcgctcggcctcgccgcggccgcgcacccgttgctgtccgccctgctgcggctgcccgacggcggcgcggtgctgaccggccggctgaccgccgcggcccacccgtggatcgccgaccacgcggtgcacgccaccgtgctgctgcccggcaccgccctggtcgaactggccgtgtccgccggcacccggctcggctcgccggccctggatgagctggtcctggccgcgccgctgaccctgtccggcgccgaggcccgcgacctcacggtcaccgtcggcccgcccggcccggacgagcggcgcccgatccggatccactcccgcccggccggtgccgagcacgcgccgtggcagttgcacgccgacggctcgctcggcgccgcccacccgcgaatcccggccgcggacctggcgacctggccgccggtcggcgccgagccgatcgacgtggccgacgcctacccgcggatggcgcgccgcggctacgactacggccccgccttccagggcctgcgggcggcctggcggcgcggggcggacaccttcgccgaggtgcggctgccggccaccgacgacgggtacggcctgcatcccgcgctgctggacgcggccatgcacgccgacatcctggccgacgacgggccggcgctgctgccgttcagctggaaccgggtggccgtgcacgcgaccggcgccggcacgctgcgggtgcggatccggcacgacgacggcgacgcggccaccatcgcgctggaggccgccgacgagaccgggcaaccggtgctcaccgtcggctcgctcgtctcccggccggtcaccgccctccccgcgggcgacggccaccacgagtcgctgtacgacatcgcatggcgggccgtcacgccgccggccggcgtcaccgagtcggccgaggtgcacgtctgcgtcaccccggccggcctggacgtgccggccgcggtccgggcggtcgccggggaaaccctgcacgccgtccagcggtggctcggcgacgccggccgccgccggctggtcgtggtcacccgcggcgcggtcgcggtgcccggcgacgacggcgtcgacgtctgccaggccccggtctgggggctgatccgggccgcccaggccgaacacccgggccggatcgtgctggtcgacgcggacccggcgaccagcgttccggacgcggtgggcaccgcgctcgcggccggcgaaccggagctggccctgcgcggcccggccggatacgtgccgcggctggctccggcccctagctagctagacgaccggcaccgtgctggtcaccggtggcaccggtggcctcggcgcgctggtcgcccggcacctggtggcccggcacggcgtcggccggctgctgctggtcagccgccgcggcccggccgcacccggcgccgaccggctgcacgcggagctgaccgcgctcggcgccgaggtcaccgtcgcggcctgcgacgtggccgaccgtgcggcgctgcagcggttgctcgccgaggtgcccgacctgaccggggtggtgcactgcgccggtaccgcggagaacgccctgctcgaggcggtcaccgagacgcagctgcgggacgggctgcgggccaaggcggacgccgcctggcacctgcacgagctcaccgcggaccggccgctcaccgcgttcgtgctgttctcctcggccggcggtctggtgctcgcctccggccaggccgcctatgccgcggccaacgtcttcctggacgcgctggccgtgcaccggcgggccgccggcctgcccggcacctcggtcgcctacggcctgtgggacgtcgacaccgggctcagcgccggcctggcggagacccaccgggcccggatgcggcacctcgggctgccgccgctggccgccgaggacgggctggccctgctggacgccgcgctcaccgcggaccggccgctgtcggtgccgatccgggtcgacgcgaccgcgctgcgcaaccgcaccgacgaggtgccggcgctgctctggacgctggccgggcggacccggcggcgggtggtcgcggccgagccggcggccggcccggcggcgctggtggcccggctcgcggcgctgcccgcggcggcccaggaacgcgccgtgctggagctggtccgcaaggacgcggccgcggtgctgggacacgaccggcccagcggaatcgccgccgaacgaggcttcctcgacctcggcttcgactcgctgaccgcgctggaactgcggaaccggctcaacgacgcgaccgggcaccggctgccgccgacgctgatcttcgacttccccagcccgggggcgctcgccgcgcacctgcaccggaagctggtcgccccggccgccgcgcccatcccggcccgggcggacctgtccaccgccaacgccgaagacctgttcgccatgctcgacgcggagctcggcggctgagctccggcacgaaaaaagcgccggggagccccggcgcttttttcgtgggcggtcagcgccgcatcatctccgggcgctcggcccgggccacgtagtccgagacgtcggcgctctgccgcggcttgcgggccaccgccgcctgcaccgccgcggccagccgctcctgcttggcggcctcccgcgcgggccgccgctcggcgaattccgggagcacctcggccgcgaacagctccagcgactccaggatgtcgcagtgccggttcgcgccgatctgggcctggaagatgatctggtcgacgccggcctcctcgtacgcccggatcgtctcggtcagctgcttcggcgtgccgatgcaacggcgcagcgcggcccgctcctcgcgggtcttgtcgtccaccgcggccaggaacgccgcgcccgggtcacggaccaggccgagttggccgcgcaaccgctggaagtcctcggtcacgttggactggccgggccggtgcttgccgttcacgtagtagtgcatgaacgagtaggcgaagaagtgcgcgccctccagaccgcggtccagcgccacctcctcgtcctcgtgacacgagaacggcagcaccagggcgaactgcgggttgaccgcgaaaccggccgggacgcactgctcggacgcgatcacccggtagtacgcgtcgacccgggccttggcctcctcgggcgagatgaaggcgaacgacagtgcccccagcccgttgcgcgcggcctgctccaccgcctccgggcggctgcacgcggcccacagcggcggatgcggcttctgcttcggcttcggcaccacgttgcgcggcggcaggtccaggaacgcgccggaatgcccggtgaacggcgactcggtgagcagccgggtcaccacctccagcgcctcctgccactgctcctgcttggtggcccgggacaccccgaacgcctccagctccagctgggtgctgccctggccggtgccgaagtcgacccggccgccggagatcaggtccagggtggccagtcgctcggcgacccggaccgggtggttgaccccgggcgggagcgagacgatgccgtgcgccagccggatccgcgaggtgcgggccgccgcggccgccaggaacacctcgggggcggaggagtgcgaatactcctccatgaagtggtgctcggtctcccacacgtagtcgaagccgagcttgtcggccagctcgatctgctccagggactccaggagcatccgctcctcgctgtcgtcggcccacggccggggcagctggtggtggtacagcagtccgaatcgcatgtcagcggcccatcttgccgagcgcgccggcgtcgatcttgaactgcagaccggtcacgtaccgggactcgtccgaggccaggtagacgatcgcgtgcgagacgtcctgcggctccatgtaggggatcggcatgccctggaacgcgtagaagccctcccgggcgtcctcggcggtcggctcgtccaggtcggggcggaagatctcgtacgtcgcccggttctggatcatgtgggtgttgacgttcgccgggtgcaccgcgttgatccggatgttcagcggcgccagctgcaccgagaacaggctggtgtacagcaccagggtctgcttggccatcgagtacgcggccccgcccagacccatcgggccggactcgccgtgcccgggcatcagcccgaccgccgaaccgatgatgatgatcgaggcgcccgcgcccaggtgcgggatcgcgccgtgcaccgtgttcagcacgccggacaggttcacgtcgacgatctcggtgaacgtccgcagcggccggtcggcgcccagctggttcacgccggcgctggggatcaccacgtccagccggcccagctcggccaccccgtcgtcgatcgcggcgtgcaccgcggcccggtcccggacgtcgacccggcggtggaagacccgccggccggccttctccaccaggcgggcggtctcctccagctcctccgccgtgcccatcgggtagtcgatgacgtcgatgtcctcgcagatgtcgagcgcgatgatgtccgcgccctcctcggcgaggcggaccgcgtggctgcggccctgtccccgtgcggcgcccgtgatcagggcgaccttgttctccacgcggcccatctggaggccctcctcgagtcggtggggccaccgtcggtgaccctgcccggctagaggtaccggctgtgcccggccgccggaatccggagcggcccctaaccccggcttaggggtcgctcagaacacccgcggaccggccagcagcagcgcgaggtcctcgcggcaccgggcgttgagcttgcggtagacccgggtcaggtgctgctccacggtgctcatcgtgatgtacagcgtgcgggcgatctgccggttcgagtgaccctgcgcggccagcgtcgccacccgctgctcggccttgctcagcgtcatgtcggcggcccggtcgtcggccgcggccgcccgggggcgcccggccggcgggctgcccggctccggtgcggccaccggcgcgagcccggtgtccgaggcgtggcaggccttcatctcctgcgcggcgcggctcgccgtctgccgggaccgttccacgtcaccggcctgccgctgggcctgactcaggtcgtgcagggcacggcccagctcgtaccggtcgcaggccgcctccagggcggacaccgactgcttgagcagccccacccggcgggccgggtcgcccagcccggccagcagccgcagcgccgcaccgcgggcccggccgtccagaccacgctgctggaactgctggtgcagcaggtcccgggcctcggccgggcggttcagctgggcgctggcctcggccagatcggtgcgccacgggaccagtgacggcacgtccagattgcgttcccgggccagcgtgcccacctgccggaagtccttggcggcggcgaacacccgctcggtggccaggtagtgccgcccgcgggcctgcagatagcggatcccgcacagcgtggacagcatcggcgccggggtgaccgtcgtgcgcatcacctcgccggcccggtcgtgctcgccgagccaggtcagcgcgttcgccagcaccgacaggggatagccgaccagcacaccccagtgttccggggcgagccggcgcagcgcctcctcggcgtagtcgcgggccaccgcgagatcgccgcgacgcagcgccacctcggcccgcagataactgaagaccgcggtccagctcgccgcgccgcgccgggtggcgtccgcgatcagccgctcgcaccacgtcgcggcctcgtcgtgccggttgccgtgggtgaagatggacagcgccgcggcgatcgtgctcaccgtcgtgtcgccgagcgaatagttggtcagcacctgctcggcactggcgatcaccgacgcgtccgggccggaccgccacatcgtgcacagcgcgtcgatcgcccgcgcgaagatgttgccggccgcgtcctcccgggccgggaagctctccggcagctgaccgaacaggatgtactggttgagccgcagctcggcggcgatccccggctcggtcagcagggcgtgcgtgttcgccgtgcgcatcaggtcggccacctcggtgagccggccgttccacagcgcgttgcggatcaccaccgcggtgtcccggccggtcagctcgccacggcgcagcgccgacagcagctccggcaggtgcggcgcggccgccgccgggttgagccggtccagggcgcggaccagcatcgcggtgatccggatccgctgcccgtcggtcagcccggcggacagcgccagccgcaggcacttgatcgcgaactgcacgcggtcggcggcgagcgcctgatcggccgcctcgcgcagcaccggcaccgcccacggctccggcggctgcccgcccatcaccagctggcgggcgatctcggtgggcggggcgccgcaccgatcgagcaggctggcggcggccaggttctgcgcgccgcgctgctcggccggcatcgtctcgagcagcagctccgggacgctggggtggcggaacgcgccgtcgctgagcagccccgcctcggtgagcacggcgaccgcctgggccacctcgtcggtggtgatcccgagcagccggctgacgttgtcggcctgcgcgtagtcaccgagcacggcgaggctgtacgcgacgtcgcgcagcggggcgtcacaccggtacaggcattcgagcacggcgtgccggaaggcgacgcccggctcccggccaccggggacgccggcgttgtgcaggtccatcgccagggccagggcgagcagcgcgttgccgccgctgagccggtgcaccaggggcgccagcgcggccccaccggcgcccagccgcggggtgatcagcccggccacctcggccacgccgggccgggccagcagcacccgctcgtgcgggcggcgggtcagctcggcgctgaacgccgaggtgcccgggcgcggcgtgttccactcggtgaccaccagcaggatccgggccggtccgagccgccggtgcaggtagagcagcagctgctgggactgcgggtcggcgaactggacgtcgtcgacggtgaccaccagcgggccgccgcgggccaggtccagcatcaccgcgaagatcgcccggaacgcggtggtgtcctcaccgccggcggtgagcagcccggcgatccggtcggccaccccgatcggcagccgggtggtgcagaacaactgctcgacgatgccgaaccggagggccgactcgccgcgcgaggcggacgcccgcagcagcagcgcgccgccctcctcggcggtctcggcgaactcgttgagcagccgggtcttgccgctggcctggccgccggagacgaccgcgagccggccccggctggcggacgactcggtcagcaggtcctggagcagggtgagtgtgcccggatagggcagggccgggggaaagcccgccgtcgtgggcgcccggctctgcaattccatccggtcgtacgcattctcgaaatccacacccaccccagtcgccgcgccgtatcggtgcccagagcggttgttctatcacatgggcgcaacggccacgggacgtcgcgccgctcattgtcggaaaacagtcccctatgaattggcggtgcccgggcgggcggtgggaaaggctggtatgtccgaaaaggagggaccctctttaggggggtcacaggggttaccgcgcccggcgtcccggagcagtctccggggagcgcttcatccggaatgacgcctgaccggcgccatggcgaacaggaggcaatgatgaacgacgtgagtcggacaatcgacgccacgctcatcggcggtccggcggactttcccccggagtttcgtaaccagcaggtcgccgccggcgcgggaaaagttaaggttgccttctatggcggttacgagcacttcgagaaccgggacagcgaaacgccggaaatcctggtatgggtcggccggacccgcgtcgccgaatgagataggcgcgcccttatcaagaaccgacaaatcgggagacttcaatggttgaggcttcaatggcgcaggacgacagcacggtgaccgagccggcgctcgcctccggcgtcccggtgccggcctccggcgtcccggagctcctcgaggagctgctggtcgagtccgtgtcgatcgatggtatgtgtggtgtctactgacccgcaccgccgccccttcgatctggacctggcctgggagctgcacccgcgggtggcggtccggccggaggggttcggcgccctgctctaccacttcggcacccgggagctctccttcctgaagagcccggacctgctcaccgtcgtgcgcgggctcggcgagcgcgacaccgcccgagccgcgtgcgtcgcggccgggctgcgccctgaccaactacccggatacgccgtggccctggccagcctggccggatccggcatgatccgccgccgcgaggacacctgatgacgacaccgatgccgctgaccggtcacttcgagcggggactggccgcgccgatctgcctgacctgggaactcacctacgcgtgcaacctgtcctgcgtgcactgcctgtccagctccggccggcgggacccgggcgagctgaccacgcaggagtgccggcggctgatcgacgagttcgagcggatgcaggtcttctacgtcaacatcggcggcggcgagccgaccatccgccccgacttctgggacctggtcgactacgccaccgcccaccgggtcggcgtcaagttctccaccaacggtgtgcggatcaaccgggagcgggccgcccggctggccggctccgactacgtcgacgtgcagatctcgctggacggcgcgaccgccgaggtgaacgatgcggtccgcggcgccggcacctacgccaccgcactgcgcgcgatggacaacctggccgaggccggattcgccggcttcaagatctcggtggtggtgacccgggagaacgtcggccagctcgacgacttcgcggccctcgccgcccgctacgacgcccagctgcgactcacccggctgcggccggccgggcgcggcgccgacgtctggccgcgcctgcacccgaccgccgaccagcagcgcgtcctctacgactggctggtcgaccacgacggcgaagtgctcaccggcgactccttcttccacctcgccgcgtacggcaagccgctgtccgggctcaacctgtgcggcgccggccgggtcgtctgcctcgtcgacccggtcggcgacgtgtacgcctgcccgttcgccatccacgacaccttccgcgccggcaacgtccgcgaccacggcggcttcgccgcggtgtggcggtcctccgagctgttcgccggcctgcgcggcgaacagtccggcggcgcctgcacctcctgctccgcctacgacgcgtgccggggcggctgcatggccgcgaagttcttcaccggcctgcccctcgacggacccgacccggaatgcgtccgcggccacggcgctaccgcactggccaccgccggggcgacgccgcgacccagccccgaccactcgcggccggcgcgggcggcgcgcgccgtcccgatcagcatcggccgccccggaagcgtccccgtcggcatcggccactccggtgctgctgctgtcccggccggcattggtcactccggtgctgctgctgtcccggccggcattggtcactccggtgctgctgctgtcccggccggcattggtcactccggtgctgctgctgtcccggccggcattggtcactccggtgctgctgctgtcccggccggcatcggtcactccggtgccgccgccgtcccggcccggccgtgcgacgagaacccgctcgccggcctgccggcctggaactgacgtgcggctagccgacctgagctggccggagaccaaggcccgggcggccgccggcgccctgctcgccatcccgctcggcgccaccgaacagcacggcccgcacctgccgctcgccaccgacaccgacgtcgccgtggcgctctgcgaaaggcttgcggcggtacgcgacgacgtgctgatcgccccgcccgtcccctacggttccagcggcgagcacgccggcttcgcgggcaccctctcgatcggccagcaggccaccgagacgctgatcgtcgaactcggccggtccgccgccgagaccttcgaccggctcctgttcgtctccgcccacggcggcaacgccgaaccggtcacccgcgccgtccgccagctccgcgccgaaggccgcgacaccctgctctacacgccacgatgggccggcgaaccgcacgccggcgcggccgagacgtcgatgatgctggtgctccggccgcagacggtggcgatggagcgcgcggtcgccggagacctccgcccgctcgccgagatcctgcccgacctgcgccgcggtggagtactcgcggtgagcccgaccggggtgctcggcgacccgaccggggcgaccgaggagtccgggcgcgcgctgctcgaccggctcaccgccgacctgctgacccgcaccgcgcagtgggcgccgcggccgacgtcgtagcggcatatcacgccgcgaagcttcgcgcggaaaatccacaccagcgcgttgtccacaggctatcgccggaccggctcgagctcgcgccacaatgtcaagggcggttccccctgggagggcgggctattggtggggcacggcttccggcggggcgggcttccggcggggcgggcttccggcggggcaggcccccggcggggcaggcccgcggcggggcaggcttccggcggggcgggcttccggcggggcaggcccccggcggggcaggcttccgatggggcggacttccggcggagcggaccgttggtggggcaggcgttcccatggagcggcccctcaccaagcccgccgtctcccgttcacccgcgcagtcgcggccgcagcgcggtcgccgaccggcccttggccgccgaccaccacacccccgcgccgtaggcgatgtcgtcgagtcgccgggccaccccgtaccgcaccgggtccagccggatccgcccgcgggacccctgggtcgcatactccagcaccacgtcggtcaccgcggccaccgccgcgacccgccgcacccgcgccgagaacaggcagccgaccgcggtcgccggccaccagtgccgggtgaccagcgcggacgcctgctgcagcacggtgacggcgccgccgccggtcaggcgcatcccgaggccggccgccccgtcgacgtcgagtttgcgggcgatccgggcggcggtcaccgcgtacaccgcggccgccaccggcagggaccagcggcgctgcgccagcagggcggcgcccagcgcgacaccccagggtggcaggacggccggggcgaccgactcggggtgccgcagggcgagcgggtgcgcgccggttccgtattcggctttgcggacgaaccagtcgccgaaccgcacccggtgctcgtgcgccgccgccactgacggctcgaaccggacccgccaaccggcccgcaccgcccgccagccgaagtccacgtcctcgccgacccgcatgtcctcgtcgaagccgtcgccggtggcgctgacccgggccaccaggcaggcggtcgaaacccaggagacgtacgacccggggcgcaccgacgcggggcgcgagcccaggtcgagtgacgagcgggattcctcgtaccgcccgatccaggtttccgaacgtgcggtccgcagcccggtgatccgggggaccgccaccgccgtgcgcgggtcggcgaagtgccgcagcagcgtcgggacggtgccggggtccaggacgatgtcggagtcgacgaaggcgacgaacggtgtccgcaccgatcgcaggccggcgttgcgggcgcccgccgggccccggttcaccggcagggccagcaggcgggcccggtaccgcgcggcgaccgccgcgatcgccgccgggttccgtgaggcgtcgtcgaccacgatgacgtcactgcccgccgggatgctggccagcagccgggccaggggcgccggccggtcgcgcaccgggatcacgtaggtgacgccggcgtcggccggggccggcaggtcggccacgaccgggtgggcgaccgccagatcgaggaggcgctcggcgagcgccgcgctggccgggtcggtcacccgcagggtgcggccggccagcagccgtcgcgctttcggggtgagccgcagcaggtgggtgccgggcgccccgccgagcagcgcgcggccgccgtcgacgacacgggtgcgcacgtccagggcgacggtgtatccgtgcggcagctgcattgccggaagctatccgggcccggcccggccgggcacccctaccgcgcagtcaaggggtgccgaggatccgccgcaccggctggggctggtcgccgcgccggccccactcgcgcgggtagccgagcgacacctcctcgaagcgcaccccgtcgtaccgggtggtgcgggggatgtgcaggtggccgtagaccgcgacggcggcccggaaccgcaggtgccagtccgcggtccggtcggtgccgcaccactggcggaactccggatgccagagcacgtcggtcggttcccgccgcagcggccagtggctgaccagcacggtcggcagggccgggtcgatcgcggacagccgctgctcggtgtaggcgacccgggccgcgcaccatgccgcccggtccgggtacgggtcggggaagagcatcatctcgtcggtgcagacgacacccgcgtcgtacgccagcttcagcgactcctcccgggtggtcgcgcccggcgccagccacgagtagtcgtagagcacgaacagcggggcgacgaccaccggcccgccggcgccggtccacatcggatattcgtcctccggggtgaccacgtccaggtcgcggcacagctcgaccagtgactgataccgctcgtcgccgcgcagccggaccggatcctggggatgggtccacagctcgtggttgccgggcgcccagatcacccgggcgaaccggtcgcgcagcaggccgagcgcccagccgatgtcggctgggcgctcgcccacgtcacccgcgacgatcagccagtcgtccccggtcccgggccggatccgttcgacgacctcgcggttctgctggtaggagacgtgcaggtcgctgaccgccaggagagatcccgtcacggcggtcaacaatgccatcccggcgtcggaaagtgctccgcaggccgggccgggctgcggtcgtaccaccggcagaaggcagccgacgggagtgctcggccatgaccaccggcacgtcgttcagttgccgggagacgccgacagcgcgccatctgccggcctgatcggcgtgttctgcgcggcggccagccaccaccggcccgcgcgttccacgagtacgtagagcgccatctccgagaagccgcccgcggccagtgcctgccgacggatctgcgccacgacgacgccgggcgcgggtgccagaaccgacacgacttcgaaccgcgaggccggcgccgggggcgcggtcaccggcgccgaccggtccatcaagcggtggtgaatcgcgttcaatccctcgaaacccgtcagggtcgctccgtacgggctgccccacaggatgtcggcggcgaaccaggcgtcgtatacgtcggcgtccaaggtgtcgccgcctcgttgcaactgtgccgccaggtccgcggcgacattctctgcagtcgttcgagccgccgggtcgtccagcaccactcgttgcggtatttcgtccatcagccgttcctcgcgatcggtgccatgcatgcgaggaacgttaggaactcaaccaaggttgaggtcaagccgtggtccgcggtgaccgccaccaacctcggtcaccacggcgtgccggcccccggggcgtcgctgagcttcggcttcaacggcacgtcgaccggcgcggatccgcggccggtcgacgtcacgcgcaacggggcggcctgcacggtcgcctgaccccggctgctctcccggatccgcagctcggtcagcagggtgaccgtggacgggggccggtcggggtcggcgatccgttcggcgagcagcgtggcggcggtgcgtcccagctcgtaggtgggctgggcgaccgtcgacagggccgggcgcagcagccgggcgcccggcgcctcgtcgaagccgatcacgccgagcccggccgggatggcgacgccccgatcgaccaggcactcgaccgcgccgacggtcatcaggttgttggcggtgaacaccgcgtccgggggttcgccggcgtccagcagcgaggccatcgcggtgtagccgccgtcctcacggaagtcggcgtggcgtaccagcgcatcatcgatcttgatcttgtgggtctgcagcgcgcgccggtagccgcgcagccgctggacggcggtcgagaccgcggccggcccggtgatgcaggcgatccggcggtatccgttcccgatcaggtgggcggtggccgcctcggcgccgtgctcgttgtcgaccagcacgctgtccacccgggtgccgccgatctgccggtcgatcgcgaccaccggggtgccggcctcgatcagccgggtcacgttcgcggtactgcccgcactggagatgatcacgccggccatccggtcctccagggcggcggtcacgtatcgcgcctccttggccgggtcctcgtcgctgttgcagagcaccaccgagtagccggcccgctgggcgacatcctcgacgccgcgcacgagcgcggtgaagaacgggttttcgacgtccgagatgatcaccgcccacagcgtggtgcggctgcggcgcaggttgcgggcgaccatgttgggccggtagttcagctcgcggaccgcgtcgcgcacccggtcggccaacccgggatcgacgctgtcgttcccgttgagcacccgggagacggtggccggagagacccgcgcacgctgcgcgacgtcatagatggtcgccatgatcctcattctgctcgtcgcgccacccggcggtgtacccggcaatcgcctgcggtggtgtgccggagttcctagagtgactcccatgccgcgtctcccgcgtgtcctggccgctctggtggccggcacgaccgcgttcgcgccggtgccggccccgccaccgctgcatcagggccgcgtcttcaccaaggccgacgacacccgctgcctgaccggcggcgccgtcggcgcgctgctgagcgtccgcgcctgcgacgaccagacgcccggtcaacgctggtatcaggcgagcaccggcgcgctgtacaacgggctgaactgcatccgggccgagggcgcgctggtgcgggtggcggcctgcaacggcggcgacccggcccaggactggtggttcatcgaggagatccgcagcggacggtacgggccctgtctgaccgacgagggcgacggcaccgtccggctgcagccgtgcacgtggacgctgaaccagaaatggatctccagctcctgaacattttcgcacatagatagccacacttgaatgtcttgaaacattctggcaatctcggcgtgtgaccaccgattcatgtcgaggaatacgtgcgaacgtgcgccggctgctgatccggtcggcggtgctcctgctcggagcgggtttgatcagtagcgtcgccgcctccccggcgcaggcgctgcccaacaatctggcgctcaccccgccgatgggctggaacgactggaacgcctacggctgcaacgtgtcggaggcgctggtcaaacagaccgccgacaagatcgtctcggcgggcctggcgaccgccggctaccagtacgtcaacatcgacgactgctggatgcagaagagccgcgacgcggccggcaacctgcagcccgacctcggcaagtttcccgacggcatcgccggcaccgcggcgtacgtgcacggcaagggtctgaaactcggcatctacgaggacgccgggacggccacctgcgccggctacccgggcagcctcggacacgaggcgcaggacgcgcgctcgttcgccgcgtggggcgtcgactacctgaaatacgacaactgcaacaacagcggctccaccaccaccgcgcagtacatcgcccggtactcggcgatgcgtgacgcgctggccgccaccggccggccgatcgtctacagcatctgcgagtggggggtgaacgcgccgtggacctgggccggtgacgtcggcaacctgtggcgcaccaccggtgacatccaggcgaactacgccagcatgctgtcgatcttccaccagaacgtgggtctggccgcctacgccgggcccggccggtggaacgacccggacatgctggaggtcggcaacggcatgaccgccaccgaggaccgcgcgcacttcagcctctgggccgagatggccgcgccgctgttggccggcaacaacctggtcaccgccagtgccaccacgctgtccatcctcggcaaccgctcggtgatcgcggtcgaccaggactccgccggtcggcagggtcacctggtcagctccaccggcgggctcgacgtactggccaaacccctcgcgaacggcgacgtgtcggtggtgctgttcaacgagaacgcggcgaccgccacgatcagcaccacggtcgcggcgatcggcaagtccggggcgtccagctacgggctggccgacctgtgggccggaaccagcggcagcaccaccgggacgatcagcgccggcgtccccgggcacggcgtggtcatgtaccgggtgtccggcggcaccaccggcggcggcaccgacaccgtcgtcaccatccgcggcgccggctcgggccgctgcctggacgacccgaacagcagcaccaccaacggcacccaggtggtcatctgggactgcaacgggggcggcaaccagcgctggacccgggtcggcaaccagctccaggtcctcggcaagtgcctggacgcctacaacaaccagaccaccaacggcaccaaggtggagatctgggactgcaacggccagaccaatcagcagtggacggtcaacgccgacggcaccatcaccggcgtgcagtccggcctctgcctggacgtgaccggcgccgccaccgccaacaacacgctcgtcgaactgtggacctgcaacggcggcagcaatcagaagtggacgctgagctgaccctgccggtcggcgttcggtaatccgctgctcggcgttcagcaatgcgacgccgggcagcgcctcgaccgcgcgttctccgccgcttccgatttctcggggcgcggggcccggcggctcggcaccccccagtatggaaccgccggaccccgctggactgccggcaccggtgcggtgcgcgacagtattcaccggctcgtcgggaacgggccgatgaatggggagaggcgtctgttccgcggagggattcccccgtttttgatctccccgcgggtagcaggacactaccaagccgagtgccggggctttccgcatatttcgccgcgaagcgcgctataaccgggcgaaaaaattagggtgatctaatcaacatcaaacatttcgcattgcaagtaataaaccgtatagttcaatcctgtacgacagacggcggtgccgggaccgccgcgcggtcccggcaccgcggaatcccggtcaggccggggcgttccagccgagcacggccttgcccgagccggcgtacgacaccacccggtaccggtaggtcccggccgcggcgctgaaggtgatcgcctcgcgggacgtctccccggtcgatttcgccacggtggtccaccggccgccgacgttgcggtccaggtacaggtcgaagtcggtgccggacggtccggccaggcaggcggtctgccggccacggcgcgcggtgaacgacgcgcccaccacggtggcgccctcgccgatctggccggtggcgtgcgacgcgaacccgctctggcaggccccggacggcgccggagcggacgtcggcgaggtggccgggctgcgcgacggcgtggcggtcggggtctgcggcggtgtggcggtgggggtccgcaccggggtgccggcgccggtgcaggacggttcgccggtgccggccggtacgctgacggcgtcccaggcggctttgacggtggcgcattcggtgccgttgccgaacagttgggcggccgcggcgaccgaggcggcccgggccttggcgtggttccagccggctagctagctagcacatcaccgtagtaggcgccgtgcccggccgcgtcgacgatgtcgtcccgggtcagctccggcagcaccttgcccgtggtggcatccacgaacacatgcagattactcggcaccacaccgccggcagcacgcttggcacccgccacgaccacctcgtacgccagcacaccggcaccctgcgccaccacctgcaacgccgccggagacaccgcgctcaccttgaccaactgcttctgcgcggtccgcgccgccgcggccgccgaaaccttcgcggtcaccggaaccgacaacgcctgctcctgcgcaacatactcgttgagcacccggccgcggctgtcggtgaccaccaccgcatcaccaccatgcaccggcaaaccccgataggtccgctcgtacaccacatactgcaaaccgttctgactgaccacctgacgccgatcaagcctgtcgaaccgactcttgaaaaacgccttcggcttcttggcgaccagatccgcggccgaggacgtggccaacgccaccggcgccggcccatcggccgcaggcggctgatgacccgcggtggtggccgcgttgccctgcggcatggtgagtgcgatggaacccgcgacggtgacggccgtcagggtcgtcgccagcgcgactttgtgcttcaagcgttgctccttgaggggtcccgcgccatcggcacaccggatcgtgcccggcgttgcccggtcggcccggggtgtgcgggagagcgcggacggcggggccggctcgcggccgccgcactctcgtcggttcgacgcgagcatccgcaacgaataggccggcggcaatggaaataagaaacccttaaaacttcggtcaccgtacggagatcttctaccgcatggggttacctgtcggtagcagaacgtcatagcggcacgtcacggtgggttacatttaagaagggttatggaatacggagcgggtgccggtcgtctagaatcgcctcccggcctatccaccgaactccgggaatgctgatgagaaatgctttcgccgcgcgcgtgctgccggccctgctgatcgccggactcgccggctgctcgaccggcaccaccgcggccgggtccccggcgacatccccggtcgcgtcgtcaccggtgtccacgcccgggtccacgcccgcctccccggccggctcgccggccgtgacctccgccgcggtcccggccgcgccgtccacggcggtggcggacgccgccgccttcccggtggtgatcacccgcaccgggggcatcgccggcgtcgacgaccgggtgtcgatcgatgcggacggcgccgcgacggtgacccggcgcgggcagaaggcgcggcacgtcacggtgccgccggccatgatgaccggcctgcgccgcgccctggcggccccgatgccccgtggcgcggccgtcccgccggcgggtgcctgctccgacgggttcgtctaccagatcacccggccggccggcagcgtgaccgtggcggactgcggcaagccggccgatcccggcgtcaccgcgatcctcgacgtcgccaaggcgctgttggcgggctgaccggcgggccgtggaaccgccggactcaccagacgtcgccgtcgcgccagtcgcagaccaccgggtcggtgacgctcagtggtgtgccgcccgggacgagccgcagcagcgtgctgtcgtcgtccccgggcgtcggcgtgacgccggccggcccgagcaccgcggtcccgcccggccagcgccgccacccccgcccccgatagagatcgacagcggaggccgacgcggacagcccgcccagcgcgtacccgtggtcgatcagccgctccgcctcggtcatcaccgctgagccgaatccgcgccgccgatgcgccggatgcaccgcgaccgcttccacgtacccgcaccgcaccgaccggccctggtgcaggaactgccggcggaccaccgaaccgtgcgcgatcagggtgccgtccacgctgatcagaatgtgcagtccgccgagtgcgtgctcccagtcgtgatcgtcgaaccggccgccgaacgcgtcgtccagcagatcccggatccggctgcggtcactcgggctcaggtccgcggtgtgcaccgaatggagaacggtcatgccgcataatcgcagaaatccggcacgatggcgctgatcgccgcgcgtggccgtgagccggccccggccctggacactgcggtgaccgccgaaccgtcggcggtctacggtgacccgcatgtccacccccgtcgccccggcccgcgtccgtccctcgatcaccgtgctcaccgctgtcgtggtcaccgtcaccgcctgggcctcggccttcgtcgcgatccgcgccgtacacgcccacttcggcgccggcccgctcgccctcggccgcctcgccaccggcaccgtcgcgctcaccgccgccctgctgatcacccgcggctgggtccgccccaccgcccgcgagtggtccctggtcgccggcgtcggggtgatctggttcggtctctacaacgtcgccctgaacgccgccgagcaacgcctcgacgccggcacctcggcgatgctggtcaacgtcggcccgatcctgatcgccgtcctggccggcgtcttcctcggcgagggcttcccgcgccgcctgctgatcggcgccggggtggcgttctgcggcgtcctgctgatcgggttcgccggccgcggcggcagcgccgccgacccgctcggcgtcgccctgtgcctgctggcggcggccgcctgggcggtcggtgtcaccctgcagaagccggccctgcgccgcctccccgcgttgcaggtgacccagatggcctgcaccgtcggcatgctgaccacgctcccgttcaccggcggtctcctgcacgacctgcgcaccgctccgcccgcctcgatcgccggcgtcgtctacctgggcctgatccccaccgccctggccttcggcacctgggcgtacgccctgacccggatgaccgccggccgcctcggcgtcaccacctacctggttccgccgctgaccatcctgctggcctggcccctgctcgcggaaaccccgcacctgctcgccctggccggcggcgccgtcgccctgaccggcgtagccctctcccgccgccgctgacggcgctgtccaagatctgtattcgcgagggcggcttccgccctgaacgcgtcgagtggaggtggggtccggggtcaggtgcggccgtcgcgttcctgggcggcgcgcagcgaggcggcgtgcgggacccagtcggccagccgcaccggatagccgtcccgcttgagccgccgcaccacatccgggtcgtcgtccacgaccaccgcgatggtgccctgcgccgccaggcgttcgagccggccggccttgaaatcgcgggccgggcgccggtcgtcgtcgccgcgcatcagcagtcgtccggcgggcagcccgcgctcgacgaaccaccgctcggtcaccgcgcgcagccgttccgggcgcccggtcagccacaccagttcgtggtcacgggcgtattcccggaccaggtccgccccctccgcgagcagcggatcccgcccggccgccgcgaagaaggccggccagttcctcggccggttcgcgatgtgccgcagccggtgccgcacatccgccaccaccccgtccacgtcgaaaaccgccatcgcccgctccgtcatgatcgacagcatggcattcagcggacgtcgcccatcaggcgggagatcgggcgggccgccgcgcccagtgccacgcccaggatgatcgccacagcgccgaggatgccgaagtaggcgacctcgtgctcggggctgtagagctgcgccaggctcccggacgccgccgtgcccagcgcgacggacaggaagaacagggccaccatctgcgtctggaaggcgtgcggcgccagcttggtggccagggacaggccgaccggggagagcagcagttcggccacggtgaagacgaacaggatgccggccagggcgagcagcggcgcgctgtgcggtccgccgccggccagcggcaggaagagcaggaacgccagccccatcaacgtcgtaccggcggcgaatttgatcggggtcgagggttgccggtcgccgaggcgggtccagagcgcggcgaacgccccggacaggatgatgatgaagaccgggttgatcgactgcacccaggacaccggcatctcccagccgcccaggttgcggtccaggcgctcgtccgaatagatcgtgaccaccgtgagttgtcagatcattagtaaagcgtgtcggcggtgcacggcacgcgctgagggcgttggtacagctaggagcgggtttgccaccgttcgctggggtaggcggctgccgaaccatccggctggatcacccaggagacgggtaccccgtcggtgatgtcgtgggcggttcgcttctccgcggtcggcatccggatggccactgtcgctccggtcggcgggaccaggtcttggggttcggctgatcgcgcacgactacaccatgacgtcacgccgccctcccggatgtgcaagcgctttgcgcccaagtagatcaatgatccgggacgatccgccgccggttgccggattcggtgcgaccgtgtgactcagaatctcatacgcgccggcccccgggttgccttgccggcggcgcatttcggtgagcggtcgaaatttccgaaccagcaacctcacgcgcacggcccctggtggatctatccctcgtacgagccagcactcacaaggggcttgaccaccttggcgggctgcacgtcttcacttatgttgccaaggccgaagccgccggccaggccaccgcggtcggtcaaaccgggacggctggccaaactgccccggccgggcgcttttagatcagccgcagccgcggcgggcgcaccctgccacccgcgtgagaactcacgaccccgggtggcagccgcaaacctgccggcgatgccaggcccacccgatcctgagcggtcccgggaaacagaagtatctctgctggtggtgcgtgttcccggtcaagacccgcccccgccttgcaaagtctgcggcgaaggcaagcactggaccaagggctactgccgcaactgccacccgagcgcgagccagcgtggttgccttgactgtctctcctggggacccgtccgcatcggtggcctacctgcctttcagggcagctggtgctacgcctgctcgcagaaccgtcggcgctatccggtcgggccctgccggttttgccaccgcgaggcagcgctcctgcacggcgtctgtcgcctctgccggcacgaggccggccgtcgggccggctcgggtcaccagatcaggccccttgaccggctcaagcagcatccgagtcaacagctgttcttcgccgagatgctgcggcatctccaactgggcgggctccgccgtgtcgagccgcggccgccgccgccagcgccagcatcctggggaccacccgtcggggtccagggcgtcctgttcgacctgaaccgggacttgtcgctcttcgtccgcaaggaggccgccgtttgcgacgatccccggctgtttcacgctcatgctgtgtcggccagactcgcggataggggcggctggtcccatcacaccgtcctcggggtcaaccgggcgctgaccgcagttctgggctgccggccggacgacggacagcagattcgcatgtcggagctacgccagctcgggcgccggaagatgtccgctgagcgcaccgccgaggtcctgaacgagatgggcctcctgcacgacgacaccccggacgccctcgcggcatgggtcgaccggcaactcgacgggctggcgccacggatcgagcacgaggtccgtcactggatcgacttccttcgaggacggctgccgcggtcgaagtccaggcccgtcgagggcgtctaccgcgagctggcctacctgctgccgccgctgcgggcatggtcagatcgatacgactcgttacgcgaggtcgtccgggacgacatcaaggcggtcgccttcgccaggggacaagacttggactaccgcacgcaccagctcacggccctgcggtcgctgttccggcggctcaagcgggaccagctgatcttccgcaatccgaccacccccctatcccttcctggccgggaccggcttgtcgccgcccggccactgcccgacgaggagcttcggcgagccgtctcctgggcggcaggccgaccggaacgaaccgtgctggtcggcctggcgatcggacaggctctccggccggttcagatgcgtcggctgctcgtcgtcgacgtcaacctcggcgagcggatgctggtggtcgagggccagccctggcctctgcatgacttgacgttcaacgcgctgaccagctatctcgaccacaggcggacccgctggccgaacacccggaacccgcacctgctgatcacccagcagaccgcggccgagatcgggccggtcagcaagtcatggtccaagatagtgatgaagcctttggggatcaccctggtccagctgcgccaggaccggctgctcgatgagctgatcgctcacggcccggatccgctccacttcatgaccgtgttcggatgcagtgacaccaccgcgctgaggtttctccgggtcgccgagcagttgctcgggcacgatccgcgtttccgtcgctgacgctgcgatcgtcggcgcggtgcgtatgcgttcacgacgttggcgcagtggcgggatcattcctagatggggccgcacccgaagtttggtttgggtccgccgcctaaatctcttggccggagcggacgacggacccgactgacacagtttcccgcgtctactagtaagagtttccgaacgaccggttcgcttacacaagcaagatcatagtgacctgaatcacaaaataagtcgcctagtgatctaaacgcgcgcttgtgcgagatgtcgagccacgtcgatagtcaagagtgatcggtcgggcctatatgtgaattatgtcacgcgctaggccctgttggttgagtcgaggccggacagagaggacgatacctctcgcacaattcaacacggcgatacccaatctttggccggagcgggggtcgccagctgacacaggagtacccctttgagcgagatcactgcgggtgagcgcagccatgactgcgaacagcactcgcgcgccttgaagcgcaggaccatcaccggcggcacgatggtaacgagcctgggactgcactttgtcccctgggagtcattcaccactgccggaaacgtcaccgacccgaccctgcacggggtggcggtcgttgccggcgccgttttcgccatcgacgtggcgatctccacgatcaggcgcgtgaaggactgggcgaaggaccgtgtcgttgtcgtccacctcggatcgcggggccggccgccaggcgacgagtgatcttgactttctcgtccacatcgtccgagcggggctcgggagcaaggccggcgatcccggagcgctccgagtcccgcaccggtggcgaggttgacgaccgtcgacctcgccaaccttcgcctggccgtgacaaggaccccattcggggttcggaccccgcgttcgacgccttcttcatgaataccttcgggcaggtcgtgcggcgactgctctattcgggtgcctcacgcgcggacgcggaagacgcggtccagcaagcaatggctgccgtctacgaacgctggtccgagatcggcgaacctgaccgtttcgttcatgtcgtagcccgacatgcgctgatcaaaatgcagtcacgggcgcatagggaggcccagcggtgggccctgcaaggcggacctttcgtggtctccgaggaatcgggactcgactcggctgccctggaggccgatgccgttaggggcctcttcgcactccttacgcccatgcagcgccaggtcatatccctctactacgacggttaccccaccaacgagatcgccgacagcctgaacatcagccagagcaccgtccgagtgcacctccagagagcccgccagattctgcggaaagcactctcgtcggtcgacgggtagagacggtcccgcaaagggccccgtggatgccgctctgcggcccaaccggggcccttccgacgccccacgctcccggaccagcttcctccggaacttagaggcgaggtgctgctcagggcgttgcaggggtttcaagttcgccctgaggcagcttcagttcccatgaacttgccgcaggcgtctccggcgggactcggacccgcggtcttcaccgtgacagggtgacggggactccaggctcccctacggagacagggcgggcgagaggtccgcagcggtgccgggtcgatcgagtcggggccgggcacctggcagaaaagatcggtactgttcgctgcttgtcggggggtgtccctatagcttttgtcaagcagcgagcgcaaggttttctaccggtttgtgctggtagggcgttgaggtgcggagcatggcgtgcaggacgtcgacgcggcggcgggccaggcagatgagggccgcgttgtgtttcttgccttcggctcttttccggtcgtagtaggcccggctgagtggatcggacagggcagcgaatgcggacaggaagaacgctcgtttgagctgcttgttgccgcctttgggtggatgctcgccgcggatgctggtgcccgagcggcgggtgaccggtgccaggccggcgtaggcggccaggtgtccggaggtgggaaacgcggcgacgtcgccgacttcgagcaggatccgggctgcggtcctgaccccgacgccgggcatcgagatcaggaccgaggaaagagggtgagcgtcaagcatctcctcgacttggacagcgacttggtctcgttgtttcagcaggtcacgcagattttcggccagcttcggcaggatggtctcggccgcggtggtgccgggaacgaccacggtttgcgcgtcgagagcggtgaagatttgttcgacgagccggacgcccatgcgaggtgcccgcggcttggcgatctcgacgagtttcgaccggccggccttgcgcagcccggtcgggccgccgcagcgcgataacaggtccaggacggccgcgtgctggactttcgggcccaggactcgttccaggggcgggtggatctgggtgagcagaccgcggatccggttgctgatgcgggtgacctcaccggcgaggtcgtcgtcgtagccgaccagcatttccagctcggccagagtgtcgtcgccggcgtcgacgcggcgcagcgtgtgcggcagggtccgggcggcgtcggcgatcacgtaggcgtcacgggcgtcggtcttggccgttcctgggtgcaggtcagcgagtcggcgcatgaccaggcctggcaggtaggcgatctggtgcccgcaggctcgggcaaccgcgacgggcagggcgccgatcgaggccggctggtcgaccaccgccaggatctggccgtgacgggccagcttgtcgaacagtttccgcagcccggcctcggtgttcggcagggctgcgtcgtgcagccgtttgccctccgggttcaacgcgaccgcgtgatgatcagttttgccgacgtccaggccgaggaacacgccgtacgcgttgtccacgctttgcctcccacgatgtccaccatgggctcggccgctggtcagagcgtcggactgccggcagccacgttacggagagacctacccagcatcgggtggccgggtccctatcagcggtcttgccgacgccacccggcccggcgacaacaccccccggatcatgtgtgcgacaggggcggtaagtcataccgggccgagcgaccgagcagcccccggctgggggcgatcaaaaaggtaacggggcaggggagatgcgggtcccagccgcagcgctcgcacctggcccggtgtgcacagacgtgaaaagggcgctgggtcgtccggtctggtcaccacgatccgtcagcaggccgtagccgctgagtggatgcacccctgcgtggagaaaaccggattcgaaccggtgacctctggattgcaaaaccagtgctctgccacctgagctatttccccatgtgccggccgaaagcgccggcatcgagcctcttcccttcggaggagcggccgcgaccccatcatgttcgacggtctcccgagcaccggccgtcttcggccggcctgggcggcgccttcccgtgggttgcaggttccacgagggtgctgcgtacccggagcgtgattcgaacgcgcactgtgctggttctggaccagccgcctcctgccaattgggctacccgggcatgggtccgacagggttcgcacccgccgatgttcccgcgaccacgagccggatggcacggcatcgggatcgcgccgagcggtgcgccataacgcccgcgcggcgtttcgagccagcgggcgatcgccggcgacgacgacgtaaacggcggcaccgtgttgttgttccggtaccgcgacggctcccagcgcaacggcgtcggcctcgacaggcggtcgcccatgtggtggaggttgtccggtcccgcacgaacgcgggcccgtcagccgcctgatcgccgatttccagaggggcccgttccggccgggcgccctcggcgttcctgtcgctggtgcgttcttcgccggtgcgccggcggaatcacgctcacaacgttcccgacggtcgcgggtcggacggggacaaccatgaagtcatttcctgatgctgtccctccatcgatcaagaaattccagctgttcttccacggtcacgacgtcatccagctgcgccggttctagaatgtcgatcatttcggcccgcaccacctggcggcccatacggcaaaaatacatttttcgcccgccatacatgtcgcgcagcatgcccgaggcgtaagccccgcgcagcgcggcttgcaccgccagccgccagccagacggctccaactcgagccgcaaccgctggaccgcatcgaacaggtcgcgtcctaccaggactttttcgccgtcgggtgattgggtggtgatgcggtagctatggtcgggaaggcattcccagtccaaacgtgtgacgagctgctcgtctccacggaaatagcgcacatcgcggtgtccccgagagttcccttcatccatcgtcatcctatgaaaccctcattctcgatgagtgggcttatcggctcgccccatccgccggtgacgaagaaccggttctgctcggagagtaacatcggccgctatgcatgtggccgcctcaccgcgctcgccggccgccagggctggtggtgtcggctcttaatagtggtgagagcgcctattcaactttcgcgtattgacgatcaaccgctcgaccggtgtcacaccgagttacggacgatcctgggttgatcagttcgagcctgtcccggcctgttgcgagcggtatgcgtcaaagagttctcgatcaagggtcttcatggggtcgtcgtaggtgtcttggacgagagggatcagaccgagttcggcgcggatggcgttgacgaaggccagctccgaatgccagaacatgtcgtcgatgcgggtgggaacggtcttcgatccatagatcgtctttgccaccgcagtccttcgcgccatgctcacaagggtccgagcagcgctagcagtctcctgctgttgcgcgatgaactggacctgcgccagcgctgcgtcgagcgcttgcttgtgaaccatcccctgctcgtccaggcgtggcgacaatcggatgccatccgcgtagggcgcgagctcgaagggtgtctcgtggcgccccacgtatgttcggtagcggcgcaccgcagcgaggaagtctccatatgtggcctggcgaaggtcgcgccaccgttgggattccgcctgcttccagcccttcgcctgggtacgaaaagtcaagcggccgcctatccaaactccgaccaaggcgacgatagaactcacgatggcgaggtagttcgtcactgtgccctccggtgcggcgtaggccatcgaagtgcttcttcattgaagtatgggcggccaaggcactccggagcgacgatggacgggtccgactttcaccgtccgtggtcgccggggcgtagttggaccaggtggtgtgcctgctccggcggcgagacgggcggtggtgacttggtggtagcggagtgcggtggcgacaatcggggccggtgtgtcgaggacgtgccggcggatcgcggcggcgtgggcggcgatggacggggccgagggcctgcaccggggttgagagagtgctgggttgcagtggttcgccggcgcggcggccggggaatagccagcgtgattcgcggttggtggcggtgcgcgtgttggtgcgctggccggtcgccagtctatgcagtgaagccagcctcccggtcggcggcagcgacctgatcgtgaaatcgcttgtggacccagcactgttcgccgagtagtttcatctgactccatcggccggacatcgggccgagctgggtgcggcgtggcaacgtgccgatcaggcgttgcggtttgccgccgcccgataccttgctgctctccaacacgtagatggcgtcttgggtgactgctacgcagcggtacttggcccagaaaatcgcgagtccggtgaggtagatgaggacgaagatcaggaagttcgccgcagtctggtagatgaacacctgccggatttcactgtctgacggcaggaacggtgctgaacgatgcactaagtcggcgcgcggctgcgactggcggcgggccatcgggtcgggtctgcgagtcacgtgcccgttcataccaccccgtagccagctctagctagctagcttcactccgcaacgctgatgaacatcgattcaacagatcgtgttaggtgctttaagagggcatctgatcccggattgtccgcttggtaagggaatgcagtcatagccgctgccaagtttgggtggattcgccggtcagtctgagcatgattgtgttagtcatcgcccaatagaccatcgtggccgatcgctgcggcagcgcctcgtagtcgcgagctaggcgtcggtgctgcatcagccacccgaacgtccgctcgaccacccatcggcgagcaaggacctgaaatcctttctccgcacggcgtggcacccgctcgacgtcgatgccgaggcctgcgccgtgacggagcacggtgttctggtagccgccgtcgacccagaccttgctcaccgtcggatgctcggcggccagcgtgctcagcaggcccttgccggctgcggaatcggacaccgacgccgccgtgaccacgaccgccagcagcagtccgagggtgtcggtagcgatgtgccgtttccgccctttgatcttcttcgccgcgtcgatgccctgctcggattcccttacgttgcaagacgttttgacgctttgagcatccagcaccgcggcgctcggttcggcgtctcggccgagcgcctcacgtacccacgaccgtagaagatcgtggatgcgggccgtggtgccgtcggcctcccacttggcgtagtagtcatagacggtcttcgccggcggaaagtcgtgcggcaggtactcccacgccatgccggtccgcgccacatacaagatcgcattgacgatctcccgtaaatcatggaccggcggccggatccccagaccccgccgtgcctcacgccactgcgtcagaaccggctcgatcaacgcccaccgcgcatccgacagatcagttcgatatggaagtcgctccatccccatgctcgaccaacgaacgatcacagccgatgacgtgcacaaacgtgaactatccccttagaggatcagatgccctctaaggccgaacgccgccagcagatgcgggccgggcggcggattcccgcggcaccgccgctgctcgctggctgaggcgcgccagttcgcagcaccacccaatcagcctcttggcagctgcgtcgacacgcagcccgatgatcgaggcgaatcaccactgtcgatcaatgctatgcttccgtgcgtcacaacgcagggggagtgtggtgtctatcggtgagtcgcgttgtccgggcgcttcgccgccctctcatggagtccaaggtcgccgttgcggtggcggccgatgcaaacccggcggggaaacggggactgcgtccatgcgaatgcttcttgtcgacgacgacacccggttcgccgaggtgctcattgtggcactcgggaagatcggctaccagctcgaccacgttgagcgggccggcgatgctgtcgcagtctcggcgtacgatgcggtgctgctcgaccttaatctgcccgatttggacggcctagacgtgtgccggcggatccggcagcacagcaacgtaccgatcatcatcctcaccgcccgcggcgcgctgggtgacaaggtcatcggcctgcgccgcggcgccgacgactacctaatcaaaccgttcagcgtgatggagctacaggcgcggctcgaggctgtgttgcggcgcgggcgcccgctgctgccggccgcgcagaccctaggcgacctcaccctcgaccccgatcggcaccgggcgacggtggacgggtgcgagatcgagctgacccgcaaggagttccacctgctcggcgtcctggccgaggcaccgggctcggtgttgcgcaagaaccagctgatggtgcgggtgtggcaggcggccgacccgtcggcggcccgcacgctcgaggtgcacatcagttcactacgcaccaagctgcggcgggcggtcaccatcgagaccgtgcgcggcgttggctaccggctggtcccgcgcggcgacggaaacgccggctagctgtgcgtaaccgcctgatgagctgctattcggtgttgctggccgcggtgctgaccgggttgatcgtgccgctggccatctccacggtcacccgcgacacccaggcgatgttcatcgaccggcttaacgacaccgacaggctcgcctcgctggccgacccggccttgcggaccggccacattacggcgttgagcatggaactgcggcagtaccaccagatctacggcgtggacgtactgctggtggaccgtgacggcgtcacggtcctcgagcagggtgacggtcaggtggctagccgggcgatgctgcgccgctacgtcgatgaggcgctcacgggcgagcggcacgacgtgagcggagcgatttggccttggcgcgatcagccgctggtggtggcgaccccgatcggtcgcggcggcgagattatcggcggcattctgactatttcaccggtacgcggacttcaattggaggtctggcgctacctggcggtgctggcggcatgcggcgtgttagcgatgattgcgggcatcgcggtcggccagccgctggtgcgctggatcctgcgcccggtgtacgatctcgacgcgatggtgacatcgctgccggagcagctccaccgcagccgggcggccgagtccggaccgccggagctgcagcgcctggccgcctcggtcaaccagatggccgaccggatcaccgagctgatcgatcggcagggctccttcgtctcgtatgcgggtcaccagctgcgcaccccgctggcctccctgcgcattgccctcgacaacctcgcgccggcaccgggcaagcgcgaccggtcacacgagattgcggtgcaggaggccgaccgctcggccgcgatcatcgactcgctgctcgcctatgccagcgccaacgcccgggccgccgcggccaccgagatcgacgctgtgcccgcgatcgaggcgtgggtagcggcgcggcagccgatggccgaggcggctagagtgcagctggtctgccgggccgccgggccgcggtgggtgcgggtggcaccgtcagtgctcgaccaagccgtggaggtcctagtggacaacgcggtgaagtacggtgagacgcgtacccgcatttttatagaggtggcggcccccgagcccggctgggtcgaagtctccgtcgaggacgacggggtcggcatcccggacgatgagctgctgcatgcggtcgagccgttctggcggcacccgtcccggcaggtgcacgacgggagcggcctgggcctgagtatcatcggcgcgctggtcaccgcgtccggaggcgagcttcaactggccggcgtccggccacacgggttgcgtgcgacggtccgtctgcctgccgccagaactgagtgcgatgcccgatgaagcgccgcgatctcggtcggctcgcgcttgggtcagcgttgctagcggcgggatgcagtggctcaagcgcggaagcggacgagttggtgatcgcgaccggcagcgtgggcggcgtctacgaccggctgggaaccgctctggcgtcggtcggccagcgcttcgccctgcagatgagcgccgtccgcacggccgcctcgattgagaacatgacgctgctaggcaaccgggctgccgacatcggcttcaccacggtggactgcgccagcttggccctaggcggtgaggcgccgttcccggcgccggtgccgattgccgcgctcgccgccctctacgacgattacctgcagctggtggtgcgggctgacgcgagcatcggcacgctggccgatttggcgggtcgtcgggtgtccaccggcgaggtcggctccggcaccgacatcgccgccgagagggtgctggcggcggccgggctggccggacgtgtacgcatagcacggcagtccctgtcgaccgccgtggccggggtccgggccggcgcgctggacgcgttcttcttcagcgctggtctcccgaccccggccatcaacgacctcgtgcgggccgagccggggatcatccggctgctgccgctgagccagctggtgggcaggctgcagtcggagttcggcgaggtgtacgccgagcgcaccgtcccccgagtgacctatcggatgacagccgatgtcggcacgatcggcatcaccaacgtgctagtggtccggcgcgacatgtccgacaacgtggcccgacggctcaccgcgctgctgttcgaggccggcttccagttgcgcgacgcccacatcgacgccgagcagatcgacccgcgttcggccctgggcacgtatccggtaccgctgcatcccggagcacagcagtactaccgagccgccaagctcttcgtcgactgaatgtgacggagcgccgatcgggccgcttggtagccgcacatgccgtgtacacctgcgccaggcggcgtggcggccgagcagaggaagacgccggggacgccggtcgcgtacgggtcgatggcccagcgcggccgtgccaccagctgcgccggcgtattggccccggtgaggatgtccccgcgcacgtagttggggttgccgccagagaactgggacaccgtatgcaccgaccgggcgacgatccgctcgcgcagtccgggcgcgaaccgttcgatctggtcgaggacggcgtcggtggcgtctccgtcccatccgctcggcacgtgagcgtaggcgtagaccgggtggatgtcaccctgtgaccgggccgggtcggccaggtactgctgggcgaccagaacgaacggccgcgtaggtaggcgtccgtcggtgacctgcctttccgcgtacgcaatctcgttcagctctcccccgacatgcactgtgcccgcctgccgggccgcctccagccgccacggcacaccgccctcgactgcgaggtccaccttgaatgccgcgggaccgtgccgccaccggcggtaggcgcgcgcgacccggggcggcagtcggtcgccacagatgcgcgcggccgcggacggcgcgacgtcgagcagcaccaccctggccggcggcagatcggccagcgaccgcaccagcgcgccggtctggatcgtgccgcctagttcaaacagatgccgggccagcgcgtcggtgatcgcccgggaaccaccccgggccactggccagccgtgccggtgaccggccgcgatcaacatcgccccgatggcggtgctcccaggcgtgtgcaacggccgcatggcgtgcgcggcggtccccgcgaacagcgcccggctttcggccgtacgccacagccgggccagggccgacgccggcgcggccgcccgcagtccgaagcggccgagccggaccggatgccggggaacccgcagcaccgggccgagcaggtcagttgcgagcgtgtcgaagtccgcggccagcgggccgaacagccgtcgccaggtcgcgccgtcgtcgccgagcgcggctgcggtgcgctcgatcgaccggtacagcgcggcgccccggccgccgtcgagcggatgcgccagctccaccggcgcccaggtccaggtcagcccgtgctggtcgagggggagcgaggccaggaacggtgaggccaccgccatcgggtggaccgcggagcagtggtcgtgcagcacgccggggacggtcagctcgccgctgcgggtgcctccgcctatggtttcggccgcctcgagcacggtcacggtcaggccttgcctggccagcgcgaccgcgcctgccaggccgttggggccggagccgaccacgatcacgtcgatcatggccgccgcttcggggcgcgcacgcgacgaccgcggtacagcgagccgttgatgcaggcgaagcgcagttggaggcccactccggcccggtcggcctgcagatgcaggtggggcatgctgctgttgccggaattgccgaccgcgccgatcagctggccggcctcgaccgtgtcgccgaggcggacggtgaccgtgcccggtttcagatgggcgactgtgaccagctcactgccgttgtcgatggtcacgcggttgccgtacgggggcgcaaaccgaatcgtgccgggcgcctggtcctcgatgccatcgacggcggttacgacccggccggcgcagggcgcgacgaccggctcgccgtaggccaggtacgactcgagccggctcgcatcaccccgctgggggccgatgcggactaggtcgacggcgccgcgctgctcggggacggtagcgtgatggttaatcagacggccgccgccttgcagtacataccagtcaccgtcgacgggaaacactgccagcggccgctcggtgctttcgggccaccggtgccggcgggccggcacaagcagcgcgactaccgcgacgaccagaacgacgccgacgatcagactgtcggcaccgccctcagcggtcagccgcggcaggcgggccgtcgaggcgagggcgagagtgaacagcagagtgaggggatggttcgcccaccaaggccgtacgggcagagcgccgagcccgcggatgaacgtgtacatcgccacggtggtcagcaggagcccagcccagcccagcaccgacctggctgtccagcagccgatcgccccccacagcatcggtacgtagggcaccgcgtacccgatcagctcagcccggcgcccggaacggacacgtccgcgccgtgccccggcgatccacagtccgctcagcgcgccgccctcgtccgtttcggcccaggccagcacctgcccctgcggtccttcgatcgctaggccgtctggggtatcgatgacgccggtgatgccgccgagccggccgtgggcctcgtcaacgacttcgcgaagccgctgctcacctgcccgggccaccagcgctggcgccagccgcggccaggtctgcggatcagcgcgcaagaacgcgtccagcgcccgcacctgggcatcatgcggcgacacgcgtgtcctcctccatggcgacgaccgctgagggcaccggcgcagtgaagcgccggcgataacgggctagggtcgcgtcacgcagcctcagcgcgtaccggtacatggtcttgtagtcgtcgtcgcgcaggcagacgctgtcagcgcccagcatcaacaacccaaagcagactagacccatgaataccataatgcccagatgcatcccctcgatggcgaggatgaccgtcttgcggacccagccgcgcaccgatagcaccgcgaacgggaacgcgagctcggtaaagacggtgaagtaagtgacggcggtgccgatgaacgcattgctcattaacgccgcataggtggatgacagcgcgaagccggtcacgtgactgatgtagtacatggccacgccgtcctgccactgctcgccggtcaccttccagtacccagccatgaaatagaggacgcagatctggaacaccatgaggtacgcggccaggttgtgcaccgcggtccgcaggaccggcgcctcccgggcgagcatgcgctcccggcgattgcgggctccgggcgcgaagtaggcgttggacaccgtgaagatcatgaagatgatcacgatctgggccaagttgtcgccgccctcgaggacatcctggttgcgccagtgcagcgaccagagcagcaccgcctgcgcgatggtcaacgatcgcccaccaaagatcatgaacgccagtgagacgacgatgactaggtggaacacgatctcaaaccacacccgcgagtcactgagcaggaacagcgagaacccgtggtgcggcaaggcggtacgggcgacgccggccgagtagtacgacgtcggtccccaaaggaattcacgacggtcgtagtcagccaggcagtacaggatggtcgcgaacccgatgacgatgcgcatcagcgcgatgccgatgagccggtgctcgcgcacgctgatccgcgccaggaaggtgtcgagtcggttcatcgtgctatccccggtatgtaggtgagccagctcgtgtcgagcagttccttctcgggttgtgccggcggtgggtcttggtagcgctgcgagaacggcacgatcgatcgcgtacggaaccgagcccgcaccgcgacgatgtcccggcccgggtagagcccgtcggcgctggcggagaagaaccgctgcatctcgacaaagaagttggcgtactcgtcgaacagcttcttgcgggcgtcggcctgctgatcggccggcatcttggcgatcgcgctcgcggcccgggcgaagttgttggccgacgcgttgaaggccagcatgatgccgggggtcttggtcggattggtccggaagctgcgcggctgccggtcgatggcctgctcaatctcggccggcgcgctctcggttacctgcccggttgcgtcgcgcagccgcacctccaggtagatgaggttgttggtgaccggcgggttggggccgaacagctgccagtcctgccagaagtagggctgtaggagtttgggcacgaagtcgagacggttgcgggccggtgaggccggcgcgttgtagatcagcgtggccgcggtgaacagcgccaccaccagcagtagcagcggcacggcgacccggatgcgcacgggtagggcttcgcgtggggacatgacggttccgttcctcccagtgaactcagtgccttcggaaccaggagaggtacgcgggaccgggtgagcctaagccggtagcggcgtcgtacccggtggtggccgacaggccgtagtcctggcccagagtgaacaggacgtatcgcagatcgccctggtcggcgccgagatcgcgcaccgccgtcaccggtgcggtcggctcggtcacgtcgtgcaggacaccagcccgggacagccggtacagcagcgggttggcgaacccgatcgtgcgccccgatacctgctcggcgccggcctggatggccgcgaacccggggctggccgccgacgtgccggcgtacccgatcagctggaacgtcccgccgagggtatagccgaccagcactggcacggcgaagtcgccctccagcgcgacgtcgggggtgacgcggcgggcctgacccccggccgcagcgagcgcagccggcaccacgccacgctggtaccacggctgaggggcgtcgcccggcccgccgccgcctccgaagacgaagaccccgggcagcggcgtccaggccgtgccgtccgccgaacggattgagaggtcgtcgcccatgctcgtctcccaggcgtaccggccgtgtgcatcggtgcctagcgccgtcccgccgaccgccgtcacccacggcgaggcggccggccactcggcctgggccgcggttgtggccgggtcgcagttcagtcctgcgtgggcggcacccggcgaggcgtcgccgcagtcaccggaggcgaagtagacgccgatgccctcgacggccgcttgctcgaacagccggttccaggccgccacgaggtcgggcgtgaggtggccgggatcggcatggatgatctcggcccacgagttggtgatcaggtcggccgagcggttgtcgatgatcgagctctcggcgtccatcaggtcttcgtcgaggcacgagttggccccgacgtagcggacggcggcgtccggcgcgtagccgtgcacggtctccacgtccaaagcctgctcaccggcccaatcagcaggtggcgcacagtccggggtgaggttccacgcgttcgggtcgacgtcctcgcggtactggccgggccggaacggcttgtcgccgacagcggtggcaaatcggtcggcgtcggcgcgcatggtgggcgagccgtaggcgccgacgatggccacggtcctgccgcggccggtggtcgtgacgtggtaagccttgcgcagctggtccgggcggtacgggcaggtggcgtaggacgaaatgctgccgtacgcgggtggcatgtcggccgccggtgactcgccgagccaggaggagcacttggccggctcgtcagcatccgccttctctcgcacccgggcctgtggcccggccagcctcgcggcagcgtcggcagccgcgctgaccggggtggacagtgaatgggccgcagcgctggcgcccgccacccgggcgactgccgcggccgggccggtgatccgcaggtagtgcgaggtctcgccggtcacccggatgccgtcggcggccagccgagtcagcaggtcgcggtgctgcgcatcggtgagcgcgaatcgccgtcggtaatcggcgggcgacaggaaatggcggtacgacggcgaccgcggatcggtgactgcccgtgccagagaatcaagatcattctgatcgcgtacgtcgatatagaggcgggcgaccgcgcttcccgctgtttcggcagcggccggaaaagtatttcctaccgacatcactattgccgccgccgcggccaacaatgcaatcgcccgcaccgtaagtaacctttctagaaaagagtggtcccctgccgacggcagccgtaggtcaccgccggcagggctgtcccactatgggaaagagagcgccggagctggcgtcagctggccacgtcgaactgcgcgtcgccggatcgatccgcggccgtgccggtggctgggccgccggagctggagctggacgacttcggagccagtgccgccgccaccaccgcggccgccaccgccccggcggccgcgttggcggcggcctgggcgacggcaccccagaactgcggatcggccgaaccgttgaaagcgacgatcggggcgaccgaggcgggcttgacagcctcgggtgcgggcgacgccatggccgcctggtccaatcccacgagcgaggccgtcagaaatgtcggtacggctacgcccagggcgacaaaccttttgatggacatcgagatcctttcgagaagacagattccgcgcgcgtgcccttacgttaagacatcgacggccgcaaaacaggaagggttctcgatatcggttcttccttgaggttcgtttgagcctcgagcttgaccagttgacagtgccggtgttctctagtagggcagccgccattcgtgatcatggctgagttttgagggtgaggcggcgggcgtagtgggctcgtctggctcgtgcctggtgacggcgtcgccaacgtgaccaacgcaaacggtgagcgatgctgcgtgccggccgaatcagtaggacgttgatcaggcggcggatctcgttgacggtcaggtcgatcatgtcgggctgaccgggacggtccgccgatcggacgtcggcggtgcagatcgcgaggaccgcaagcgctgccagggcaagggtggtgaaccggtgccaagacgtccagcgacggacctaaggcgtgttttagaagctggtcatagccactcgccgatgatcacgatggttagggcggcttggaagcggactgccagcttttcgtagcgggtggcgatgccccggtagcgcttgagtcgggcgatgctgttctcgacggcgtgacgcatgcggtagagggccttgtcgaacttcggcgggcgtccgccgcgggatcctttggccttgcggtgggcgtcctggtccttcttgctggggatgcaggccttgatccctcgtttgcgcaggtaggcacggttggctcggctcgtgtaggccttgtcggccaggaccaggtcgggacaggtgcggggccggccgacaccgaggcgggtgaccctgatgcggcgcaggaccgggatgaactgggggctgtcgccgcgatgcccggcggtcacgaccatcgacaacaccttctggccctgttcgcaggccaggtgcgtcttggtggtcaaaccgccgtgggaacggccgagtgcgtggtcggcgggttcgtcgtggacgccgccgggtggctctttctgcaggtggccgttggtgcgagcgccggcggcgtgctgatgggcgcggctggtcatcgagtcgacgctgaccgtccagatgatcctgccgttggtatcggcggcggcctgcaatgccgcgaggatccggtcccaggtgccgtcgcgctgccagcggcggaacaggccgtagaccgtctgccagggcgggtagacggcagggacgtcacgccacggggtgcccatccggattcgccaccggatcccgtcgatgagctgccgtttgtcccacttcggcggacgacctgtcgtggacgcggcaggaagaagcggggccagcacggcccactgccggtcggtcaggtcatgccgcctcgtcaccgctaaggtggccacgaggtctccggtatgaagttcttgcttggtcgcagaaccagataccggagacctcttcagttatcgatcaccgccacgccggaacatcgatcaaccatcagcttctaaaacacgccttagcgcctttacgccagcaccaccagggcgaggggcttcatccagcaccagttcgatgttgccgaaaccgctgccgcgggaatatccgaagttgtaggagacgtaataccagctcaatggtcacgcccccagcgcgctggtcgcggtgagctgtcggatctcgtcacgggccgctttcgctttcgccagcgcatccgtgagttcgtccaggtagccggcgtactggccggaccgaatcatctcctgcagctcagccacccgcgccgattccggggtgaccatctggtcgtggcccggatcgcgctgggccgggatgtgcatgtcggtgacggtgacggtcatcgggtcgcctccggaaacagcaccccaactttgccgaggaacgcttcgccggcgggggtgaggcccatggtgtcgtccttcgtgataaagccgttccagacggctgacacaaacccctcggttgtccaatcgttagtaccgccgagttgtccgtcgcgggctagccggagtacgtgaacgacatccttaagcggaacagcggcggtatcggtcatcggacggccgcctcgtctgcaaacctaatgcgcgtccaatttcgatggctgatctccaggtcgccagcctcgaagtcggccagcatcgcagcgcagtcggcctcgctgtaggtaccgtcgccgtagccccagccggacaggttgcacgggccgcggtagccgttacggcagtccaggacggtatagaggacgtcgcagtcgttgctggtcggaccgtcttccgggtcatcgtcgccgttttcccactcgggatcgtccagtcgggtgagcacagcgaagttggcggtaacggctttgacggtccacgggttcggatcgtcgtccagcagggtcgtgttaccgatgcggaagaggcggggctgcatggcccagcgtccgtcggcgggcgggtggaagctcatggtcagttctcctcaaggttgaaacggtcgacgatcacggcggccagggcttccgggccgaccggtttcgggtgccggtagccggcgccgcggttctgttcctcagcgaagtccgacaccgcgtgtgcctgcacgggcgtgaccaggccgcggtcgaggaggaattcgctgatcgaggaagcaagctggtacgggctcagttcgttgtccttgtcggcttcgcggatgagcacggccaggtcatcgcggagcgtggtcactggtcgtctccgtccaggccgaattcggcgacgatcagttccgccagcgcgccggcacccatcaggcgctccggctgaggtaacgggcgttgtcgccgtccggccctgccagcacctgcatcacggcgagtacgtcggttaccatctcatcggtacgcacctcgggccggccggcgccgtacttgccggtgcaccgcagcacccgagcaatcgcagccgcctcatccaagttgacgtgctccttttcgacatagatcaagtcgcggatgcgccctccaatcaaggacatgtcagttctcctcgtcgatggtgagttgttcgccgtgggcgtgcagcccgtccggcccgtcgtagatcagcccctcgttgagcaggctgtcgagcacctggcgaagggtgggggagtgcgatagcacctggaagtgggcggcgatgtcatcaagactccgggcgccactgcggatcgcggccagcaccgtgtccctgttgacctgacggacactcacgccggctcccggtattgggccagcgcctggtcgaacgggatgtcgtcgtcctcgaaggtgtgctccgggaagtcgacgtccgggtagtcgtcgctcgcaacgtgcgcgtcgatgcctgcctgctccgcgaccgcgttcgccaccgtctccggtgacgccagccgggcgatagcgagctcgaacacgtaccgggagtcccggccgttgcggtcgtcgatacacagcaggtgccagccgcgattttcggaccagccgataccgacttcgtcgtaggaccagaccggctcgccgtttcggtggggctgctgttccatgtcgaagccgatccagccgtctcgcggatcgtttgggtccgaccacgagatgtcggttttgaagccggcctcgtcgagtgctttggccacggcgtcgatgtacgggccgtgcgcatcgtggtagccgtggccgtccggatacaggtcctccatggtggtcatcaggcgcctaccagtcgggccagctcgcgcaggtcgccgagggtgagggtgtctgcgtcgtcgccgacgatcgcggcgagaactatccggtcgtcgggcagggcccggtacaggtggagcaggcggtgcaggcgggcggtcaggtccgtgtcgggcatggctctccttgaagcgtgatgcagaattagtggcaagccactaaagggtagtgtctcagtgctgctagaaggtggcaagccgcctatgggatgatccggcagtgagtagccagcaccggcacgtaaaccggaactatcgacccgctgacgacgagtacgacccagtccgggccgaggtggaaagggctggcttcaccatgaacacgttcttccgggccgtgctgcgctgggtccgcaacgatccgcgccggctcgcccagttcaaagctctgatggtcgaagtggatgccgagacgccacgtggccggccaaaaaagaacgccccgcaggagtagcggggcgcctctttcagttaccggtccattccacttcgcggccggactccctaactgcgaacggaccaacatcggccgtccggaacagtcgcacctcgagacctgacccgattggctgccacgccagcgcgtcaagggcggcggcatcatccaagtactgcgcctcccaacggtcaatcaccccgtcacaggcatcgaccgtttcgaaccggtagccacccatcagactgctgccagcttccgggcgcgagacgtcaggtaggcctcggctgcggcgacctcggcacggttgggtcgctcatcgtccgggtcgtcggtctcgtccgggcgctggaaccagtcgcgcaggtgcgcccactcgatgcgggattcggagcccggtttggtggctgtctgccacggctgcgatgcctggatgagggtgcgtaggtcggctggtgacagtgcgctgtaccgggcgatgacgtacccgatggtgttcagggctgcttcgtccgtgatctgaggctcagcgctgtccgcgctggcgtcgatctcaacggctcgttcggtggcgtgcatgggctcgtcgaacagggcccggtcgcgccaggcaaggtggtggccctgcataaagaacatcagcatgtgctgttttgcgggcttcaggcccggccgtcgggtgttgatggcggtgatgactgagctggcgctggtggtcatcggcgcaacgtaggtgtttcggaaggtcatcgttcctccgtgtgctgactcggcaaggttgtgatcaaggattcagagcttggtgatgtcgtagtagtcccacctgcttcttcagcggcgggttcttccactgccggaacgggtccccgccgaactgcctgtacagggcggcgttctcggcgacgcgatcgtcagcgggtgggctcaggccggtaccgctgcacgttcggcatgctggccgatcacgtcgttgtgctcggcgatctgctcaccattccggtacacggtgaccccgccaggccacgggcagtatgtgacctgctcgtaccgggtgacgctgtcgtcgtggtgcacgatcaccagcaggtcggcgggcaggtcagccatcagccggccgccggtcgtcgcgtttgccgctggactcgcggagcaggtcggccatcatgaccgcggcctgatcctggatcaggggaggctgacgccgccaccggtgggtaatgtgcaacatgagatctccttcccagggcttctcgaacggcgggcccgtacatccacgcagcgggcccgccgtcatttcagtcagaagtcgtcgtagatgtggacgccgccggcgtcgaccggatgcagttcgtcccgttcgatcaccgcgttcggcacgtccttgcacagctcaccggacgcccagaaggtgcagctacggtccgcgcacaccagccggaccatcttggtgccggcgacccggagctcgtggacggcttcgctcgtgtactggcacagcgggttttgacacatgaccgtggtcactgcgggtccccgatcacagacctgatggcctcatcggcggtcccgaactccggcagctcagtcatgaggttctcgtcgaccggccacgccacccaggtcgcgccgtcaatgaacggacgtacccgggcgaccggctcaccgtccggcttgtcggcgacgaggaacagcgtgccgcggccggtcacatcgttcacccgcgggtcgttggcgtaagcgctcatgccgtcgcccgctcggaacgccagtgcgccacctcgtcgaccgtgatcaccggattgtcgaaccggcggttgagtcggtcggcgatctgctgatcggaccagtcggggtgggcatcgatcatctcgttcgacacgatgcggctgcaacgctcgccgcctatggacctgcccggatcgtaggcggtcaccgggccatgcccggccgccaccgggcaacctcagccacggtgatgaccggctcgtcgtattcccggttaatccggtccgtgacctgctggtccgaccagtcggggtgcgaggaaaccagcgcctcgacgatcgtcttgccgaccggatcccggccgaccacctcgcccgtgtagtcgatgctcacgcctgcacctcggccatgcaaaccgtccagccggtagtgcgggtctcatcggcgcataccaggccgtccggtgtctcgatcaggtccaggtcggcgggggttagggtcaggaccagcgcgcccgggtaggtatcaaccctgccgccggggtcggtgcggacgagtacctcgcggccggtgctgtcgtcccaccagacgtgctgctgctgccgaagccgctgcatctggctgggcttgagcgtaaggatacgggcggtcacgcgccgtcctcctcgatgctgacgatcgccgcggcgttgatggcctggcgcgggttctcgccctgcgggtcgtcggcgaagactggctgcagctcgcagtcttcggggccgccgatctgcagcggatgaccatcggccatgagcttgtaggcctggtcgagggtgtaggtgttggtttcgacggtgcggccgtcaaccagtctgatgcggatcatggtgtcctttcggggccggtcaggcccacaccgacacggcgtaaacgctgccgtcatcggcggtgacctggtagtcgcggctgtccttggcggtgatcttctggaactggtcgggtgtcaggaccacgcggggcaggccatcggtcggcgccatttcgccgcccttgacgtcgaacgccaccttgttgctgtaggtgccgtccgcgacggtcatgaacgtggtggtgccgttgcgggcagacataagttccgccgcgttggtgtgaatgtgctgcatggggctccttcggcatgtacgggtcgggcacgcccaccagcaccgggggaggggaggctggtgctggtgggcgaggcggcccgtcagaccgaggccggctcgaggatttcggcggcgagcaggtcggcgatctgccgggctgctttcgccgcctcgtagtccgcgatctctgcccggatcgccgactgttcagggccgtccttttcggcggcttccagagccttggaccaggtcgtgtacagggtgagcagcgcgttcaggtcggtcacggcgccaccacgttcttcagccagatcgccggcttcgaactgttggccttgcgccagccccagttgtcgtgatcggtgtagccatgcttggcaagccaccgatcggcgtcgtcgtgcccgtagatcgggtacacctcaaggtcgtacgggacgttcggattcccgtccttgattaggcgcaggtcctggccctcaatctcagccacgtagacggtactcacgacatcacctcagccacgatcaccgcagcgtcgtccgccgccgtctcgcagtcgtcgcacacaagccggccggcgtcgtctcgccgcatcagccggccacacccacagaacgcgtgttcgtcctgcggccacgtggacggcgccgacagttccagatcatggccggtcatcgggctaccgcccgggatgggtcgccgagcaggatgaccgtaacgccggtcgggacctgaccgtgccactcgttttcaccagtctcgacgcgtacgccgaggtcgaacggattggcgggacggttagcgcgaccgagcagccggcggatagtggcggtcatgacgccaccccggtcagaacatggtcgacgtgccggcgacagcgatgcttgaagtccggatcccggctggtgtcttcgccttcccacacgagcaagtgcagcggatacggccgaggcgggcggttggcgtcgatggtagcggcgtaagcgcggccgaagtcctcagcgttgtcatgctggaagtcgctgttcacaccctcggcttcgaccttgccgcggtagacaagccggtaagagaagacgttcatacgtcctcaatccatacgccgcgaagctcaccccaaggcacggagatcgcgcccctgttgtgctcgatagtcaggatttcgtccgcgggcatcccctgccggagcaggtcaacgagggactcggcgaactcccgatcactgtccggcgcgttccggatggccaccgtgccgtttgcgcttttcaggtacaggtcgaacggcatgtcagttctcccgtcgctcgttggtgccgtgctggtggtgggcagggccggtaaagggatcacggacgcttgtcgcggcaactgccagcggcagggcggtccagccgcacacgtcgcagctcgtgaggccgcagtactggcagcagcccgaccggtcctggccggcagttgcacggccgaacgtgccaacgcagtccgagtcaccgcaccggcagtcgtcgattccctgcgggtgaagggtcatggtcagtccctgcgctcgttggtgcggtgccggtggtagccgagggcttcgtcgatggcgtgctggtcctcgcggcgcagcgccgccttcgacggccggaagtggtgccgggtgtcgccgaccagctccttctcccagcggtcgaagtcgtccgggttgtcggcgccagcgggcggggcgtaggtggtggtggacatcgggtcctcctggaagtgcgggtgtgaagctaggaagtacaggtgtgaagtgcaaagcgcggatgcgaagtaggtgcgaagctcagcggcccgtcgccatgagctgccggaattgcgggaccatgtcgatcgggatgcgcagcctcagcgcggcgtcttcgtcgggaaggctgtcgacttcgatcaggaagttgccgatctcgcgctcgtcgtcgggagtcagagcgaaagcctgcgggccagcggcggccagggcggcgcggtcagcagtgagcggatgggtggtccgcactgtcaccacgctccaaccgcgtgacgcagcagctcacggaccacagcaacgtccggatcggcctgcatgtgcagggtttcggcgagacccgcaatcgtttcgtgagcgagagcgtgaacaacctgccgggccggctcgctggcgctggcggccagaacacgtacgccgtcctcgctcagcctgctgatgacggaaacagtctgcttctcggtgagccccgcgcccaggagcatgtcctgggcggtgctgtacgggtaggtggcgggtgcggtgtgcacggaatgcctccaggtgaggggtcattccggccggggcaggggagtctcagtcacgccaaccccgaccgggagacgacggcttcttgcctacccacaccatgcgctcgatggacactgcggtcaagaaaaagctagaaatttctcttacactgatggacgccaggtccccaggacacgctgcagccccgacttcgacctcgaatgcggggctgttgtgtgatctcatacttcggtgggatgctggcctaggaatttctcgcaatcgcgcagcgatcggaaggcggcgccatgcaagatttcaacatcgagttcctctggaaggacgtggcttccggcggcaacggatgccacgccatcctcaagacagacggcggttactacgttcagggccgggtggttaccggcgacgaacgggcggcagtcctcagtcactccgaagccaacaggtctgggcttctcgacgatgaggatgtcatcttcgtccatggcaacgtcctggaccggctcaacagctaggaccccggcatcagcacggctacccagggacgcctccatggatccctgggtgcagtcgtatgcagacccgagcctctttgagaggtggaactaccacatgaacggatccagcggacgcgtgtccggcgggacctggcaaaccgcctgacgaaagcgagggagacacgcgcatgcaggaccgcgaactcaagaaatggctgcttcagcccggaggcgtcgtcgaacgcctccgtcagctacaaagcacgggtaccaccaagacctccaacaacgatcttgccgctcgcgccggctggatcccgtcgaaggtgtccaagcttcgtctgggacagcaaacgcccacggcggatgacatccggagttgggttgctgctaccggcggtagcgaacaggatgagcatgaactcttggtcatgttggcagatgccgaacggcataccaccagcttccaaaaggcgctcaagaagggtcaggccgcccaccagcagacctacaacgaactcgttgaacaggccgatgttgttcgcatgatcgaacggtcctttgtgccgagcgtcatgcaaacgcgcgaatacgcgaccgcagtgctcaccggctcgatgaagctgcataagaccgctgacgacgttgcagaagctgtcgccgcgcgcatgcagcgtcgcaagttccttctcgacgagaagtaccggttcgagttcatcatcgacgaaacagtgctcacccggcgagtggcgccacccgaagttatgtattcccaggttgaccgcatcctggaatacatggacctgccaaacgtccggctcggcatcctgcccgtttacggcaccttccatgatgtcgtccgcaacagtttcgagctctacggcaagattggtgtcgttgaaacctactacgacgatgacgagctcgatgcagatggatggaccgcccatgccaacgcaatgcgtgacgtctggcaggacgcggtcgaaggcgacgaggcgcgaaagctgctccgcgccgccatgaagtaccacgcatccgacatgaacaagtcgtaggaggagcaatgcggaaagtcctcaccgacggcggacctggaaccgagttttggcgagcgttcgaaacttttaagcggtcagcttggcgctgggagcagcagcctgcttatcacttgggctacgagcaggcacagttcgatcagttccttgctggccatccggagtcgccgcttgaaaatgaagagcttggctcgtggatgaagcaagttgccgcgcacgtcaaccacggcagaacgatcgggcgcgtgcgaatcgtagaaaccccgcctaccgactaccagcggtggatgcgctggatggacaagttcaaccgcggcgcgggcgaaaccatccagtacttgaccaggcatggagcacaaaaggcgggaatcatccctggcatcggcgccgaggactggtggcttttcgatgatcgaaggctcctcctaatgcgccacgatgacaagggccgcagggtaagggtggaagctgtcgaggatgaaccagaagtagaaaaggcgatctggtggcgagcgcaagcaatcgctgcagcgaatcgcgaagctgcgagtctagaagtttgataggaagagcaaagtggcccgcgcttgaggtgccggccactttgcattatgggctacttgacgccaggtccatcgtgacgccacgattgcttatgggtgttttgctgcgactgcagaagcataggcaggtgccagaggttgccgcctgtctcgggaaagcgcgcagctagtcggcagccccgccgacggtggacgttatccagaccaagtattcgctggacccggcggctacccgcagcgcaagtacctccgggtttttccacggatggcgctccaccagcatggccttaagcggctcaaaccggctggcatgtgttcgcagcaccagtcgccactcctcgccgacgccgaactctcccaggtgccagaacaccgacttcgctgggccgctaatttgcgccccggcagcaagccgcgccttcacagcttgcttcgcaagctcaagcgcctcctgctcagtcccggtagcggtgctgacctcaatcacgtcgccgatgctgtcggaatccataacctgaccctagctagctagttcctcgccgccgcgaccacggccagcaccacgagcccggacggcctgatcgtgatcaccgtcaacgaactccgccggctgttccacgctctggtcatcgaacccggcagacgcgtcgtcgacgtcattgcctggtcaatctatcgccgccgtcatcaatccgccgccaggaccagccactacgcccgccaagcactcacggaaccctgaaacggatctcctgctggagtactagtctcgaacgagtgacggcctacagcgctcaaggacccgacccgcttgtcgtgttcatctctcagctcggctgcggcgccgaggcctggaagccagtgcttgaccacctgggccagctgcgtgccttcacctacacccggcccggaatcggcagtgcagacccgcggtcagcaccgaatccgcccttaccgcacagccggttcgccgacgagctggcagccctactcgacagcgcagggctgtcggagccagcggtgatcgtcgggcattcgttcggcgggaacatcgcccgcatgtacgccgcccgatacccgcaccgggttgtcggcctggtcttcgttgacgcatctatcccccggcagcgcatcaaccccgcagacagccggctcgtcgacggggacggcccggacgccaccgaaattgacttcctcaccggcgaagtagagatcttgaacgccaccctgccagacgtccccgccgtagtgctgcaaggtgacgcccggctgtggcctgacctcgtcagcccggtccatgccgacctgtgggacacctaccagcggatccttgcccggcaactcggttgcccactgatcctcgctgacagcgtcggccaccaggtacccacagacgccccagcgcttaccgcgatcgtgatcgccgccgttgcaaaggctgcggccaacggcagtgcagtgcacctggacgcgacgaagttcggccaggccggtggggtcatgctgtaagcctcaggccggtacgacggcggctcgcactccggagcgcgagtctcgatagggtcgacgcgacggttgacgggctctccgtcgacccgccaagaacttatgccagttctcgacgcccgccgcaccgccaaccgcgccgacccggtaggcatctgcttccgccgggacatgaccgatgaccgcccatggcgaataccaggaccggaagcggccgggcgcccgatacctgcgcccggtcgtacgagtgatcccggctcgacgcactgtatacagtcgggtcagtggcgccgcgtgatggattggtgacggtatggatcttgacgagttgtcggctgcggtgatgccctacgtgtcggccgcggtcgctgcgtacggcggtgcgatggcacagcgggccacggatgccgccgtcgacagtggcagcaccgcgaccgtcgcctggggccgccagctcctggctcggctcgttgcctcgaggcgcggccgccaggtcaccgaggcagtggaggagctagctcgcgacccagctgacgatgcgtctcgcgtgctcctgcaggcccaagtgctgaaggcggtgtctatcgatgctcacctggcggccgaactcgagcacatcgtgcaggaagcccgggctgacggcgatcattacacggtctcggtgcaccacagcagcgggttccagatcggctcaaacaatcagcagaacgtcttcatgagaccgtccaccgaatgaacggcaacatttcctcaagcagccacttccagcagggcgacgacaatactcaaaacttttattacttcatctcctacggtgccgacggcgaggccgtacgcccagaggcgatgctcgggcacgtacgcgagctgacgccggccacgctcgaggaccgcgatgaggaattggctgagttggcggagttttgctttggagacgagccttacatgcggtgggaaggcgagccgtgggccggcaagaccgcactgctcggcttcttcgtgttgcacccgcccgagcgggtcgacgtgctgcacttcttcattcggggcggccaagcgtcttggaacgacagtttcgcgttcgaacaggtactccgcgcacaactgcaggcctatctggcaacgaccgaccccgggacggtgaaccccagccttctgcacctcgaccggacggatctgcttgaccgcgcggtgaagcacgcggccgcgacgggccggcgcttggccctggtggtcgacggcatcgacgaggatcagagccggagccgggccacgcggctgccgagcatcctcagcctgctcccggccgacccgtctccggtcctgcgtgtcattctggccagccgtcaccagctcgatcagccgaccgatgtagtagaccatcccgcgctcagctgccgagtccgccgtttgtccggctcggctcgggccgctcgcctgcagcgcgcggcgcggctggagctcgacaccctgctcggtatggggtcattggcgacggatgtgctcggtttcgctgtcgcctcggagggaggcctcagcattgcggaagtcgccgagctcagcggggcggaagcagagaaggtgcgtgagacgctggtcaacggcgccggccgcacactcgtgctcactgcgttcccggacggcggtaccggtttcgcgttcagccacgactccctgcgcctgggggccagcgaggtgctcggcgcatccaagatgagacagtatcgcgcacggattgacgactgggcccgcgcgtaccggtccctgcgatggccggccgagacaccgttttttctgctcgcccggtacggcaagcgtctcgctgacgctggtgaggtgggtccgcttaccgagcttgcacgggacaccagccggcacgcccgtatgcgagacgaactgggtggcgacggcccggcgttgacggaggtcgtttccgcccaggccttgtggcaacttcagcgagatcccgatttgcgcagcgccgcgcagctggccaggatccgctgggaattgacgtcacccaacctgcatatgccgccggagttgcccgcggtctgggcgctgctgggccagcccggacgggggctgaacctgatcgacgccctggaacggagtccgcaacggacggaactccagcagtcaatgatcgacgcgttgctgcatgccggccggccggatatagcagcctacgtggcctcggacctgccggacccggagcgcgaggtggcgttgcactcggtggccaccgccctgctcgccgccgggcaaacggacgaagctgacggcgtcatcggcttcgccgccgagaagtgcgcgaacggcattgaggtagtgatccggtatgcccggctacgcggcgcgacctacgcccggcagttccggcaccccggcgtccgtgaagctgcgttttaccaggtcatcgaggggctgtgcgaggacggccggatttcggaagcccaggaagtggccgccgagatacgagacgcccaggtacgcgggctcgccgatttgacgatcgctgacgccgccggccacccgatcagcccgacccttcaccggcgcgtgctggaactagccgcggagaatccacacctgagcgaaaccatcctggcaacccttgctcgctgtttagcccgggctgggagctaccaggaggccgaaacagccctgttgcgcacggccgacccggccgacgccggtcgacccgtgctggcgatctgcgttgaggcggggtcattcgccgacgccgaagcgctggccgcacggctggcccgcgccgcgcaccggctgagtcccgtcaacgacctctgcgacctgctcgtcgatgccgaccgcccggaccgggcgctggcgctggcgcgcaccctgccgacagccgccgagcaggtgggcagggtcgcggccgttggagcccggctcatgtcgcgcggtgaccctcgtggcccgggcgtgctcgaggaggcggaacggctcgccagcgaaaccggcccgaaagggtacgcccacctggcgatcctggctgcccgtatggccgacgacgctttgatgacgcggagcctgcgacgcgtgcccgacgacgccctcgtttcggtcgcctccgcgatcgccgagggcggttgggagagtgccgccatgcaggccgtcgacctccttgatgatccggtccaggaggcctacgtcgcccttcaactcgccgaggccgccatcgaacagaaccggccacaggtggcccggcgagccgcgttgttcgcagttgagcgccggctgaccggcaccgatttcgacgtcgacgagcctgacttcgatgccacagaggtcgatccgctcgaccttgacgaggctggcgtgatacttgcaagggccgcgcggattctggccacagtgggtgacgttagggcggcgttgcgggtggccacggccgccgacaccgcgtcacgccagaccaccgatccggagcgggcggacgaggacctggcgttagttgcgtgcgccgaggcggagttgggtgatctcgagggggccgagaagcggatccggcgcatcggtgacaaagagactcgcagggaagcgctcagccagctcgcccggcttgccaccggaaagccgcgcgccgacacagaggcgagtgatgaggatgggacgggagagctcgcagcccggctcgccgaggagctgcagggtgacatcctgcaggaggtcaccgcagcgctcgtggcgagccagcgcctacggctggcctcccggctggctggccgggccgcggagcctggcgagcgtgcccacgccctcgccgtcgtagctcagggctacctcgaggttcgggacgccgaccatgccgatctacttgccatacacgcactgagaatcctgcccacgggagaaagcgtcgagcactccgagacggcggcatgcatcgccaccgtcttcctagcggccgggcatgccgatcggatcccggccgtcgagcagcagctgcgactcgcctggcagcgggccgtctttcacgcggagctggcggtgcagacgattgccggcggcacgctgacccccgatgccgctgtccgctatatccgccgagcagagcagatcgccgaggcactggtggatccatgggaacggtgctgcgccttcagccggctgatcaccgcttggagcgcggtcggcgacgccccgagcgtcacgcggatgatcgccgctgccacggaggccgccgtcggctgcgacggttcgtggatgcttcccgaaccggtcgttctaggcatcgacgcattgctgcggttggaccggccggaggaggccgctcggctgctccaagacgacgccgagcacaccccggcgatggaggtctacttggccgaggcgctcgccgagcacggccacctagatgccgcgctgcattttgcccgctcgttggcgccggagcgtgcgttcacgcaacgctggaacgtgttcacctcgggaccgggcggtgacgacgtccgcgaccaagctctcgcccgcatagtcgctgtcatggcgcgggacggcggacgccccgacgatgcgctgcggatcgtcgaggagataaccagcccgtgggcgaaggccggagccatgaccgatcttgcggtaggcctggcccgcgggcgacggcccatccgcgcgaagcaggtcatggcggccgcactggcgctgggagagtggacgatcccgttgcgcggtctcgttgtggttgaacccgacgccatccgggccgctgtctcccagcgcgtcattgacctgtaagagctggattgcagacaaatcacgcggaaagggtcgcttcgtgatcgcttgtacgcagcgtcagcggactccttgaccgccgtcggtgccgacggcggtcaaggtccgcgagaggtgccggttctcacgagtattgcgacgagcggcgctggcgaaatggtgtcgaacgtcggctctggcacgaactgcgttaataatcttgaatggcgcagatatcgcgctagggcgtgtatcgaaggcatagccattcgttgatcgcggcggtggtcacggttgcttcgtagcacacggcgagtttgtcgaagctggtggcgactgcgcggtggcgtttgaagcggttgatgccgcactccacggcgtggcgctgctggtagatcgccgggtcgaaggccggtggtcggccggacaagctgcgttgtccggcggatgcggacggtagcggccaaaggcatgatgacaccatgacgcgtcgacggcgtatctgggtgatttccagcgtggtcgtgttcaccgtcgtcttgacgacggtggtcagcgtacgagccaccttgaacaccgccagcacgctctggggcgtgatcagtgcgttggttgccttcggctccactgtggcgggtatgaaactgctcaagcccgatgtcacgccgtcggatggagcggagcttgaagctgcgctggtggccgacgtgcgccgccaattgcaggaggaggagcgtcggcaacggctgaatgatccttggccgataccggtgcaactaaggccagcggatgcggcgatcaccgatcattggcaggtgatccgtgcgggagacggtgatggcaccccgctgccgctaaccggcaacctgtcgcaaatcgacacccttttttcggccataccttccggccgaatggtgctgatcggcccggctggctgcggaaagactgtcgccgcgcgcaggctggcggtgctgcgagccgacgcctggcaatccggccagcccgtacccgtgttgctgtccctggcggcatggaacgtcacccgccagccgttgccgcaatggctagtgcagcaaatcgccgacgatcatccggcggtgccgcaggcgcgaactgtggcgaggacgctgctggtggctggtcggctgttggtgattctggacgggttcgacgaactgctgccacaggcgcgtcggcaagccttacacgaaatcaaccagagcctgtcggccccgcagcttctggtaatcaccagtcgcgcggacgaatacaccgccgaggttaccgccagcgacgtgttgacagcggctgctgtgctgcgattgcagccggtgcctttggcgaccgccttcaccttcctgcaggaggccgggccgccaacaaccgcggcccgctggcgcgacgtgcaggcacgggtgactgagcgggacccgcttgccctggtattgcggactccgctgttcgtgaccatggcccgtgccctgtacgacactgcagcggccaatcccgccgagctccttgaccgtgcccgactgcccgaccgtgctgcgctggagcgaaccttgctcggccaatacgttgatcaggctgcccgcagcatcgcagcagacagcgggggcgtcatctcgccccggcgagtggccacagtgcatcggcatctgcgaacgctggccgcgatagtccgtacgggccggacgggtgacctcagctggtggcaaaccccccacgttgtacctgccgtagcggcggctgcgccgatttccatgacactcggcctgctaggtgcggtgagttttgcggtggtgctcggcggcaagtggcaggtggcctgcacctccttgttcgccaccctggccggggtcttcgtggccgtgaccgtgggggctatcactcttcctccgcggcctaccgcaggcggccggtacgtcgagaagccgcactggatgcgggccattccggtgccggcactcgttgccggggcaggtgccgtaagccttctggctgctgccgttggcggggtcgccgcggtgtatggcgcgcgtacgctcgtcgtggatctcacggggctgctcttcgtcgttttcgccacggtctggttgttgtcgccctcgtgggccgatcttcgctacaccgactgggatcggcgtcgggaaaggtggctgggcaccgcgctagctttcacctgcggaggcgcggtgttcgtggccggcgcggtggagggacaggtgagccccgggcgggtctatcagttcgccgtgctggccgggtttgctgtcgccgcggccgtgagcggcatcattgccggccgacgccctcgtgtgcgatcacgtcacaggcggcatcgcgcgtcgcgccgccgcgtgatgctgagctggctggttgcggtgaccgtggcggcgctgctgaccgcagtagatccgtttctgtggtggggtgcggtccaggccgcggtggtggccttggctctgcggctgcttggagaaacgttggtgagcatcggacccggctaccgaactccgcgccgggtcgcccctcggctcggtgacgcagctccggtcatcgtgccacgtgtcggtctgggcgcaattgcgggagcgattgccgtgaccgttatgacgttactgttccctgcactttcctggccggtgtggtgggcggcggggatcagtacaggcgaccttccggtgccggcgttgccggcgttggcggacatggcaccgttcgtgttcgtcggcgctttgacaggattgctggtcggtgtgctgcattgggtcttggcccccatcgaccatggccggatggcgggcccccgacaggcactacacaccgacgccacagtgttagggctgctgctggccgtgccggctgctgttgccggcacattggcggccgtcctggtcggtcagcacccgcatcggcccgcactcgtgttcgtctgcgcggtcctgctgatcatgctgccggtactggtcgcagtcgtacgtacgtcggcatggttgcaataccgcacggcacatctgtggctggctgggaccggccggctgccatggcggttcctgcgcctgctcgagcaggcccgagacgccggcgtgctgcgacagactggaagcacccatcggttccggcacgtacgcctgctccatcaactgcacgtacctgcgacgaatgtgaccggttcccgccgtcgcgcctggccgccggaggagtggcctgcggcctggcgttggtcggccggcgcggcagtgtgcttgctcatcgccggcggcgccgtccgccaggccgacatcgttgcagccgctgaacagactcaaccgacgctagccacgccgacctggcaggacctgcagcggcacggcgcatgcttacccgggtgtcgggtgaccggacacgtcgccgtcaatcacaagtcctgggggcctgtcacattgcttagcacgttggacgaaagcggagatgagccgatcgctggcgtcgtcgtcaccgaccggaccgggaaggtacgttggcagcaagagttggacacgtggactgaactcacgatcgcgggccgggaccgtaccggtaatgttttcctcattttcagtatgggcggggacaaaggggtggtggtgcttcatccagtccgccgcggcttcgccgaactcggcccctcgccggaagatccgtacttcttctcaagcaatctcatcgatgccggggacggctcgtacgccattgaccaaagcatcaacgactgtagtccaccttgcgccgacggcgcggtaacgcatactcgctactactggaccggcaaaagttaccgtccttgacgagtggcatgctcttgcgagttactggtgcgtcagcgatgcagacctccaccaactgcgggaccagcagcgtctgaacaaattttgcagagtcgccggctgctcggacgaaggttgggcaagcgggtggcgacgtatgcggaaagctggtacgaccagcacccgccgatgctggcctaccgggtcgcccaggatcacgcggtatttcttgccggttcgtagcgcccccgacagagctgccttccgtcgcttccctcgccacgcactaatgaccgcgcaccgcgaagccgcgttgtactggtgagcgatttgcaaagtaacggccgttcctggccgccgttcacggctggcagtaaatgagtgaatcgcttgccttcgctttcagttcagcgtgcgccattctcgttgtcttcactttccagcccggagcgaacgctgatctctcccagcgaatatcatatctcgccgtaagatcatggctactggaagtccatctacggcttgagtaattgcgaatgcccggctcagtggcacgccggtcgcgagcagtgtgtagaagatagtactccatcgtttccaagcatcactatcaagagttcccgtggcggccgacggggcgatctctgcagcgactgatgctgaggcgcatgctgctagaacgacgagtttcggtcgtgactgacgtacgacctcgccaagtccgcgcggcggaagcgaatcgcttccgatctgtatgcttccgcttccctcaacttgggcagagagctgccaaacttgagcgtgtgcccctaacgtcaagagtgcctgactgaagcctgctgcggtttctgcgggctcaaccgaaacagtggagcccggaaatgccgcagtgataattccgcggtcttcttcgagaaaacggtcccatggtgcggcttctgagccggctatcaagaatttcggattctcgacgacttctgccacgccgccgtcctgagtatcaggcgatcctgatccggcgggcgctttcgctatcgaaacgactatctccggcgttttcccgtacagcgattcgggccgccataccgccattccggtgacgagtaggatcagcgacgctacgaggccgatcatgccgagaaccagataagtctggttaggcccgctcgtgagccctacccccacagcgaggatgccttcaacggcgagcacgaccagcgcaaagaagccgaggggcgtcttgactgcttcaacaatcgcaggccagtcgtctcgcggcctgttggcctcgcgtcgttcctcttgaccttcaaactcaggaccagccacggtgccaacataggggcggagttgcgcgagtgcaacgacatcgactatgcaggcaatctgatacctgacagtcaggtagcccggcgctctacagaattagcaacgtaagcgcgagtcccggagcgactggcttcgatcgtgaaagcgcggtcggatgacggcactgacacttcctgatcggtccgccacggaagcctccacctggctacgcttccaccggcatgattgccacctcgtagccggcatacatgctcggcatctgagtgacgaccaccgcgttaagtgcctgcgcctcgaacgccacctgaccggccatcagcgggcccgccaccgcgccgggcaactgcggatcagccagtcgcgcggcctccaccgcggtatgcatggtcagatcaagcgtggtgacgccccgggacatcaggaacggggtccacaaggcgagtcccacgttcagcgccgcttcggcctccgcgaccgccaccgtcggcagtagcaggaacacattgccgcgctcggcgtcatcgagcatctccatgaggtccggatgcccgccgaacatcgcaatcagcgcggacgcgtccaggacgcggggagagtgcgtcacgcggccgacggcgtgttgcgacgctcgatgatttcccgcaggtccgcgtccgcgcgatccatacgcgcctgatagccggcccgctgttcgggcgtcatcggtgctggcgctgacctgccaagcagcgccatgagccgctcggacgcgcgcggcgggcggccggtctcgtcagcggggatgggggcgtcggagtccatgccaaccaccttagcggggcggagggaactgtcgtcatcttgaacaagatcgatacgtttcgagaacgcctgctgctggaattcccgtcccgtctgcagctcgcaggtggccgcgcgttcccggcgttcagccaggaactgccgccagtaggccctgccggagtggcgcagccaccgttggagcttctcgtcgaagtaccagtcgtctgggccctcatgcggcggctcattcatgggatgacggtatcggccggtactgtcggcggggtaagtccgccactcgtacggatgtgccaacctcaaggcgcccggggcgagtgctgccgcgccgaccacgtgctatgccggtcgaggataccggcgaccaccagttgatcgagcaactgttggaccaggtcgtgcagctcggcgctagttcgtagcttcgccggcctgagtcgtaaacgacgcgccggggtggtggtgaggtgcggccggccactgctcgaacagcgcatcctgcgggtgggtgatgcagccgatgtcctggcagtgcacttcaccggcgtagtcgttggtcggtcgtccttcgatggtaaaggtgacggcgacgatgcgcccgttgtgctcggtgccggtaatacggcggtgtagtaccccggatgttcctggctgatattgccggactgcgggttggactccagttcggcgccgaagctggcgaccttaaccagaaggtcgccagctggtgggtcatggcgggtccattcgcggactgcgttcatgaacccgaacagtcggaacttggctgcgggcaatcaacgcctcacattctcgccttaacgtcggcgatgaacgcctcgatctcttcgggagagtcgggcgtggcggctctcggcggacgctggtctgcagggcgcagcatcgcctggcgcagggactggggatagccggagacgttgccctccgggatctcctgctgggcgcggacggtgtcgcgaatgactgtgatgtcgatggccttgccggtgggtgtagccgtccaggggccctgccctcggaccagcgcctccaggtccatggcgctcagcgcgccgaaggaggcaacagcaaaccgggctgcgtcgtactggacatcggtgaggttgctgcttagcccgtatgggatctgcgcctgtgcttgttcgcgtagggcggcagcgatgtcggtcgcggtgctcatcgccgcaacgtatgccgtcatgggggtagggggtagaccctcgccaggtgatggattccgcacatctgcgcgggtcgaagtcgtcgagtctggcaccttccggacggggtttgctgaactcccggcacttcgtagcgtatcgatgcggctacccgattggtgtcggatcacggacttgtcacggaaggtcatcattcctccatgtgctaactcagcagggttgggaccaagggattcagggcttgctgatgtcgcagtacgccttgacatcttcgggcgccgtgttctttcgcggtcggcgcggttgccgccggaacttctcatatagcgcctggttctccgcaacgcgctgatccgctggcgaccgaggctgcaggtacccgctgttggggttcgccagcacctctgcgacaagttgtcgcaggtcgccgttgccgtgaacggtgcgccaccaggcgagagaccgaggttgacagcggcgaacgagttcatcccggatctcggtgagtttttcgtcgggagcgccggcggcagcgagccagttgttgaccgggttagcttcttgatgatctaggcgatgatctctttctcgatcttcttcgggcgccagggaaggcggaccttggttcgcgcgcggagagagagactgtgagtggttgaagttatgagcggttctttgaggagaaggcccccggatctgtcgcaccttaggcacggatctgtcgcaccttgctgacggatctgtcgcacctaactcgccagtagcccccggatttgtcgcaccttcgtcgtcgtaagctcccggatccatcgcacctttagcccccggatctgtcgcaccttcaggtaccttcccaaacttgggaaagcggaaggtaacccgcctgccaggcaccgaatagaacggctggccgtgccggtccttgcctagaacgactcgcagatcaatccacttttgcgccactcgccgcagggcctcttggatacttcgctccgacagatccgtcagttgagccagtacctcactgcctggccaaccttcgggactgtcaagaaaacggtgtaactcgatgttgttgaaggtcagttgcggcctgcggtgagtcgtccttcgaaggcgaggtcgaaggcgttgagggcgggtttccagcggatcgcccagcggcggcggccggtgccggtcgggtcgagggacatcacggcgaggtagacgcatttcagggcggcctgctcattcgggaagtgcccgcgggcccggaccgcccggcggatccgggcgttcacgctctcgatggcgttcgtcgagcagacaaccttgcggatctcggcgtcgaacgccaggaacggcacgaactcggcccaggcgttctcccagagccggacgatggccgggtatcgcccgccccaggcctcggcgaactccaaaaaccgatgctcggcagcggcctcggtcggtgcggtgtagacgggcctcagcgccttggcgatcgcgtcgtaactagctagctagccaaccttcccgtgtggtgtcgctgcatgcatcggcgagctcaagcaccagaagtcgttcggcagccgtcagcaggccaggcggtaaagcgtcgcggacttcgcgccgtagtaggtagcccatcagcacgttccacggagaagctcgacggcgcagaggtgctgccgttcgacagattgggttaacttcaagggagtctcctgcgtgcaagcaagtgcatgaactaaacggccgtggtgttcgcgcaccgcggccgtcgtcatgcctgagtcctggccagttgcttctccaagagcgcgaggtcgtcaaggacttggcggtaagagactcgatgccgcgggcccggctcgcagataccgcgctcccagagcgaaaccgcagcttcgctgactcctacggcggcagcaacatgacggatcttggcgccaactgctcgccttcgacgccgacgctcggcgggagatggcagcgcctcctccaatagcttgtcgatcaatgtgacgcctgcttggggcggagcgggtgaggggaacatgccctcagcataggtgcgctacttgagaaatagctagaattttctcaatccgcctgctagtgtcgaggcatgcccgtgacggtgttcctcgccaagcccgacaacggccccgccctgcccaccggacacccggccgcagcacgaagctggatcgacgctgtctcggcgcaggtcaccgccgtcacgcactccacctggctcatctacggggtatgcggcgtcctcgccggactgctgaccatgtccctgtacggacggaaccggcgcaccaagaacaccgacaaagctgagctcaccggcaccgaccgggccgtcacccgcatcaccggcatcctcgccaccgccgtcgtcgccctcggcgcctggaaagtgttcggtgacgtgctgcacctgcactggttcttccgcatggtgctgttcttcttcgccgaagcacagatcgtcgccgcctggcgacgggtacgccgccacatccaccggcacgccaccctcggccccggcattcgcaccatctacggcatcgccctcggctccgccctggtcgccgccatggacgccgaccggatggtcgaggtagtcctgcgcttcttcgccgcactcgtcgccgcctacatgatctccgaggagttggcggaagaactcgacatccacctccaggcccaccccgccctcgccggcaccgcgaagaaggtccgcggccggatcaaatgggcgctcacccccgaacggatccttgtctggctgcgcctcgccgaaccctccgaacgcaccgtcgaagaagtcgagcggcagcggcgcatcgcccgattcgcccgcaccgcataccggctgcacctgctccgcgagaacaacgccaagaagtggcgcatcaacctcgcgcagtggtcgctgcgcaggcagaccgaagccgcgaacgaacacctgcgcctcgccaccgaccaagcactactcagcgacatgcgcgcccaactcgccctgctgtaccaagtcgaggacaccaccactcgggccgcggtcgccgacctgaacccgctccgccccacccaccccgacacccagcccggctcgcagacggtacgcaccagaactcgcagcagcgagactcgcagcgaaaccgaacgcacccagccgcccacccagaccgcgaaccaggctgcgaaacccagcgagaacccagccgagggcaccgttgagaagccggccgagaaggccactgcgaactcgggtgcgaaccccaaaacggtcgctgcgaaacccagccacccgctcgccgaccaccccgtcgacagcgtccgcaaactcgcccgagccttcgcacgcaaccgggctctcaccaacgctgacctgggaagaaaggccggagtgagtaccggcactgcgaaccggtacatgcccgatgtgcgggccgcgttcaacgccgctgagaaccagacgacccggccagagcgaacccagcaggttcgcatcccggtacccattccgcagccttcgcagcccgtccttgcgggcgtcaacggctaccaccaaacccccgaggagaacctccgatgaccgacacgatgaccaccaccgccgaagccacggtgaccctcaccgtcaacggcgtcaccaagacgttcaccgcaactgtgaacagcgacggtgaccccagcaacgccgctttgtccgccctctccgctgcgaggggcgacgccgccgactggaccggccgaccgctgcgggaggccctgcgatgaccaccgacctgaccccgtaccgcgccctcgacctaggcaccgtaggggagccggccgccctggtcgacaagcccatcggcccggtcactctgccgccgcagccgccgaaacccagcaaaaggcaggccgtcgacaccgcgggcagcctcaccctcatcgccggcgccctcaccgggctcgcgttccacgccggcagcagccccgagctggtcatctacccggtcggggcgtcgatcgccgcgatggtgatcgccgccgtcgtgcacctgcgcagcatgcccaaggtcgcacggtgaagcaccacgccagcctgcaggccctgcggttcatcgccttgtacgtgctcggcgccggactggccggactcattgcgtacctcatcgccgcctgaccagcacaaacactgaagggatcaatgttgaaggccgtccgtggcactaccgccgagcagcgtgcgaaagcccgtcgcctcgttcgcggccaacgccgcctcgcgttcttcaaagagaagatcaaagacgccatcgagggtaaaagccgggtcgagcaggcctgctactacgtccaggccgtcgccgctgaccttgacgagcgcggacgcaacgaactggctctggcagtcgcggaaatagccgatcggcggaacccgcgatgacccggaacaccgccggaaggtccaccggacggcatggcagtcatggcatggcagtcgtcgtggcagtcactgcgatgccatccagcgggcgcggtgcccgtgcacccgtgcgggcgcgcgattctaccgaccaacatccacgatctccaaacgcgaccttgaggaggtgcaccaccatgaccatcgctgacgcgttcgacggggtgttcccggaagccccgtcgaacgcggctaccaccaccgcgacccggccggcccggccgacggtggtgcccctgcgccccgccgataccacccgggcgaaagcccggcagcgtccccacgccgtgatccggctggcccgcatcgtctatctcgacgccgccgactcgtggatcaccgaggaacgctccccgtccgcgaaaaccgtgtggcgcaccgactacaccgccggcctcgacaccgtctggaccccgtaccggtactggacgtacgcgtggcggcccatcgccgtgctcgccgccctgttcttagacgccctgaaatttctgttcatccacccgttccgcggcccggtcagcaccgccatcatcgccgcgctgatcctgcttgccacccactgaccacgtctcccgaaaggagaacctagccatgctcaacatgttcagcagcctgctcgccaccgtcgggggactcatcgtcttcgccggggcctggtacatccaccagaaggtgcgactcactcgcaccgcctgcgtcatggccgccgtcggcggcttcgtcacctactccggtgtcgtcggctcctgggccaaccagtacgccaggcagctcggcatcgtctgcgccgttgccgtgttcgtcggcgtgtgcatcatcgtcgctgacatcaagggcaagaagaagggcgccgaccggcccgccttgattgcgttcttcctcgtcccgatcttcctggcgtctgggatcggtgtcctgcccacgatcaccaagggtttgcgtgacggcgtgcagaagaacaccacccagatgcagaagatgggctgaccgtgggcctcgagttcctggtctgcctgctgctggcggccttgttcaccggtggccggttcgtgcaggacaccatcgccaccgccaaaggcaccacgccaccgcatgtggaacgggcccggatccgcgccgagggacgcgcccgggcccgggaggcagctaaaccggagaaggaacggtcaccgtacgcggccggcaaacccggcctgaaggacgttgctgccgtctactggggtgacgccctgcaggacgtgatcgacgcccacgagcagcgccgcgccgagaagaaggcgcagcggcaggagaaccaggccgcgaaagcggagaaccgtccggcccggcactttcgtccgtcgctggccgagcgggtcgaacgcctcgcgaagttgctgtgggaaggcccgcaacgccccgccgaggacgaactggtgcccagcgttgacgaagtactcatcgccgaaccggcggccggtgccgacaccagcccgccgccgggtgggcccggcggatcccgggtactcatgcgatgggactgcgagcgctgcggcaccggctgcggcggctatgactccgacgacgcagccgctcaagacgcgcaactgcatctcaacaaggtgcatgggggctgcggcaaagtcgttgccggtcgcatcgagtttctccccggcgacccggacggggaaagcccggcccgccactgtgatacctgcggcaccacggtcggcatgacccgcaatgtgacccgttgcatcccgtgtattgctatcaacgcgacgcgggagcagccccacggaacgcgcccgacccggcacacgcaggggcactggggcaacggcacgtttgttcgtgcctccgcccgggattcgcagacgggggatgcctacaactgggcatgccagcactgcggtcaaacaacgcgccgggagttccccagccctgccgctgcggacgccgactactacagcacccacatgccgtgcccgatagctggcgacctgaagccgggcagcggcggcctctgcttcttcacctgcgggcagtgtgggttcgacagcgggcaaatctatcccgaccaggatgccgcccacgccgccctgaaagcccaccgatgctccaaccccaacaaccaggaggacgccatgaccacaccggcaaccagcggatccgccaccggcgacgcccacgacctcgaatcggccagcaacgagtgcgacctgctcgacggcgacctcacggcggttgacaccgccctggacctgatcgacgaacggatcacctcggctggtgctgctgccgagcggctcaaggggtttctggactcgaagagcatgccggacagcatcaccgccggaatggccaccgctctggagatgctgtctccggagcacatcaaagcgctcatcgatgccatcgccgcggccaagaccggcgtgcgcgcctccaaggaggcgatcgacacgatgaacgagcaggccaccgaggcgctgcagggcgccgacggatccgccgtcaacggacgctgaccctgccggactccatccgtgactgccaagccctcgaggtttggcggttgcggtaccagcccggaaccccccttttccttctgcgcagccttctccggagtgagccatgagtgttgaccaacgccccgccccgacccgtgacatgccgcccggcggcagcccgccgacccgcccccgcacggcgtcccgcggcccggacggtcaactcaccgtgcccagcggcgccgcattcctgtcctggcactaccgggccgcggacggcaaaacggtgaaagcccgcaagcagccggtaccggtcagcgacggcggggaactcacccattacgagatggaatgccccgcctgcccggacagtggacagtgggtcagcgtcaaatccaaggtccaccggccgctgtgcgcggtgtgctgcaccgaactacgccggcccggccagcgtcagtggaggctgtcgagaatcccggtgcggcaactgctgcaggaacgccgcgcgcacgtcaacgccaccgctacaaccgccgcggtgggagccgccgggctggttctcgacgccgctgacttcccgtggtggggcgaaatcgcgcaggccgccgccgtcccggcgtgcgtcgccgggtcgtggtggttcacccgcgcctggctgacccggtacagcaacaccgccgacttcccggacccgaccgtggaaccgacgaacgctgtgatcgcccagcgggcccggaccgccgcatacctggccgccgcagccggcgtgtggtgcgagcttgccgacgccatcaacctgaacatcaccactggagacggcggactcgccgtggcggcgctgctcgggctcggtgtgatcggttcccgcccctacctccgctgggcgcaggcgcggcgggttcctgcaccgcagcctgctatcgacgaggacgacgagccggtcgacgatacgccgcagccgactgaagctgagctgctgcgcgcctacgtgctggagcggtgggagaaagtgtcggtgaagggccgggtgttgcacggcacccggctggaggacatcatgccgtcggtgggtggctggtctgggcggatcatcgcccatgaggactccgacttggacccggagaagttcgacaccgccgagcctctgcggaagatcgcccgcgcgtactcggtgggcacgagcatggtgtcgatcgtcgcggacccgttcgacgcgaaccaggccaccatccttgtgcagcggaccagcccgctcaccaagggaaacgactggtccggcaacggcatcgacctgaaaaccgggtttgcggagacgatgaccctggaggacggcacccgcggacggcacccgttttggcgcccgggatggggtgcggtcatggagctcattgctggcgcgacaggtgccggtaagagcgagtacctgaacctgctggccgcgctggagcggcagtccggtgttgtggtgtcgtggatcggtgacccgcagatgggtcaaagcctgggtgacctgcgcgacggggtggactggttcgcgccgtcggtcgaggaaatcctggtgatgctccgtgtcgccgccatggtcatgatcgcccggaatttggtgacgacccgcatgcggcgcgaagagacccgccccgatggccgggtggtgcagcgccgcgtcaagtaccgggaggtgtccccggacttcccgctgctggcgatcaccatcgacgaggcgcacattccgatgaacgaccccgaccatggcaaggagatcaccaagctgctggcgctgctgtcgaaatccggccgcaaggccaacatcaaggtcaggttgctgtcccagtcggtcctgctgtcggagatcaaagactcggtgctgcgcggccagctcgcatccggattcgttgcggtgttccgcaccgccgacaaactcaccggcaccgccgcctggccgggtggccggatgccgggcgacccggcgaacctgcctgccgcgtgggaagacggcttctccaccgccggactcggctacgcgtcatcgaccaagcggatgcggatgcgcaccgactatgccggcgacctctacgacctgatcaccaccggtgacacgctgggcctcgaagcatcagtgctcggcgtagccgggccgttgtacgccgaccggtggaagcgcctcgaagccttcgacagcatggacccggccgaactgctgggggccggcatcccggcgaacctgctcgacagcgcccccggcgacacagcaccgccgaccggcggccgagaggccgtgctgcggttcttcgccgaacggtggctggacggcgaccgcgaccccgtgccgttcggggagctcgcgggtgcggtccgcaccgtcatcaagacccgcgcatgcaccaacgccgtcaacaagctcgtcgacgagcagatcctggccaccgacaagggcgcctactggctgaccgagtcgggcgccgagcagatgggcgttctcgaagaggtgccagcgtgacgtcagcgccgcatgtcgcgcagctcgtcgatgagagtgtgctggatgagggtgatgccatcgtggagctctttgaccagcgacgcgaagcccttttcgatggcgccgacgatggctttgttccgttcgtcggcggcacgttcccgcctgctggcgtcgtccaggtagcgagtaagggcgcgcatggtgtcggcgtcggtcatgcgctcagcgtagcggccggatcgccgtccgacgatctcagccagcgcggtgacctctcatgatgggtaagtctcatgccctgtccggcgccgtcggctggcttgctggctgtgcggtactcgcggctgccggttcggaaccttcacctctgaccgtggcgatcggggcggccgtagctaccggcatggccctcgctcccgacgtcgaccacccgcagtccacgatcgcgcactcgctgggctggctcacctgcttgatcgctgggggagtcgagcgcgccgccgcagtcctgcgcacctcgtcctgccggcactgctcgaccggccccgatcggggcgggcatcgcgggatcacccataccgcgctctgtgctgttctggccggggccatcaccacgaccgcatgcctggccgccggccgggtcgccgccctcatcgtggtcggagtggcggtgtggctgccgcgcacgccgccctgtcgtcgcggctgagggcgaagatcggcgacctgattctgcccggcaagttccgctaccacagcagaggcgcacaccggtttgccgccagcatcggagcgctgctcatcggcgccgctgctgccgcgatcgcggacactgccacgcctaggccgtgtcttcaaaggatcatgaccgtggatgatgtacggcgtgatgcgccgctatgagctgaccgacgccgagtgggaatcgttgtcaccgcacctgccgtcggtgatcaccggtggtcgccctcgtgaggacgaccgccgggtcctcaacggcatcgtgtggaagattcgttccggcgcaccgtggcgcgatgtgcccgcccggtacggctcctggaagtcgatctacacccgtttccgcaggtgggcactcaacggcacgttcaccaagatgctcaccgccgcccacgccgcagcagacgccaacgccgacatcgactggttggtctcggtcgactccacgatcgtgcgggcccaccagcacgccgccggcgcaaaaaggggcgctcggaaacggataaaccggatcacgccttcggacgatcccgtggtggactgaccaccaaaatccacctggcctgcgacggcgccgggcgggtactggcattcgtactgtccggtggcaacgtcaacgactgcacccgcttcgagcaggtcatggcggccatccgcgtcgaacgcatcggaccgggacgcccccgcacacgaccggatcatgtcatcgccgacaaggggtacagcagccgcgcgatccgccgctacctgagccgccgcggcatcgcgcacaccatcccagagcgctcggaccagcagaaaggccgccgcaaccgtgggcctcgcggcggccgtccaccgacgttcaacaagctgatctaccggcaccgcaacgtggtggaacgctgctccaaccgacttaagcaatgccggtccgtggccactcgctacgacaaaaccggcagctcgttccaggccaccgtcaccatcgccgcactgctgcagtggctatgaccctttggcgacacggcctagcgagtcatggtggtggctcggcctcgccgtgctctgggggtggctcgcccacaacctcggcgacgcgctgaccctctcccgggtgccgctgctgtggccgctccggatccggggctgccggtggacaccggtcggcacgcctcggtggatgcggttccggaccggctccgggatagaaacggttgtcgtgtggatgctcgccgtaaccggcgctgcttccctactggcgctcggactcgcgcaatgaccgaagctaacgagcacccgccgtggtgcacccgggaggaaaccctgcagtcgctgacccggcaccgctccaacgaggtgcgtgtcgggacgtggcgacggcccgcgaacggcggacaagtttcggcccggctcacctccgcctacgacggaccacccgccatcgcagtcaacgtgtggatcggcgtcggcgtgaccgcgtcgatcagtctggagcaggccgaagcattccgggacgggctcacccaactactcaacctcgctggccgcgggtagcgacccgcaatcgcgcaacggtgatacaccatgcccacccagtacgaacgcgccgtcatctcggccggcactcgctacgaggccggggtgattactgacgcgcaggccgtccacgaaatccggcaagcggcctacacggcaggcagtgatgccaccgtggccaccgccacccacacgccgacgaactggcgggagcttgccggcctcaaccagagtgccgtcgatgggccgtctaacggcgaaacggtgagaatgctggcatgacaacgcggaaaacggtgcccgtccccgaggacgtcctgatgcacctcacccacgctctggtcactgataccgcccgactcaccctcgacgcctggtcgcccggcgatgtggttcgcatgggtgacccgttcggcaaagtgctgtcgtggttgtgggtgaccgaccccgatcgtgctgtcgagctgtacaacaccaccttggaccacgtgcgccggctagcgccgggcgccaccaagcagatcacgttggatttggcgctgcagggactcccgcaagacctgccgccatcggatggcagcaacgcccgcctgatcgagcgcctgcgccaggacattccgcagcttgccttcggagaccctaactcagaaagctaacggtagacgaagaagcggcccgccccgcacaggttcgcctggcggggcgaactgctgtacagggcgggccgaagcaccgggccggttgtgacaacactgggacatacccgcctgggggagatcaagaagtgaaaacttgcgggcggtcaccaccgtggagatcagctgcggctgccgtgaacagcatcaccgacatgcggcccagggaaacccggcaaccgccgcgtacggcaggatagctcgacactaatcgatctactcggagacgcgatgaccgccgaacagccctaccaacccatcaacgcgctgccgccgccacccacattcggcgtggtcccaccggacccgcttcaccccgcaagcccgcccagacactcacaccgccgttggtggatcatcggcatcgccgccgctgccgtccttctgatcgcggtcggcgccaccatctggtttctccgcgaccggcccaaagccgaccggggccccttcgaccgagccgtcgcgaacctcgccgcagcacccatgctgcgatacacgacgactatcgccggcgttaccgccgacctcaccgtcaccggtaacggcgacagtttcggcgcgatatccatcgccggacagcacgtagatctgctcaccatcaacaagcgaaactatgtgaaattcacgaccggcctactcgggacaaaattccaaaaccggtgggtgaccgggccggcctccacagcagcacccctgtccggcacatggccagcaccagccgacctggctgacaccctattcaccgccctcgaccaggccgggcccttccccaaagacggcggccccaccagcaatatcaacggcgtggccgcccgaaaagtagccacccccaacgtcacgatctacatcaccgacacggcaccgttccgcgtcctgcggctcgacccggccagcagcggcaaaaccctgcccaccatgccgtcgctgccagccgtccccaccctgccgtccctacccgccttgccggatctgccgtcactacccggcctgcccgctctgccgaccggagtgctacgccagcaactgctgcaccaccagcagccggaacgagccccgccgccggccgccggtaaaccaatccccgggcagatggatctgttctcgctggactcggccgccaccgacaaagccttcggcactcttgccggcaacacggctcaactgacggacgccgtcgacacgagcgtgcagttcagcgcacagggcaccggcaccatctcctgcggtgtctccggctgccggatcaccacgcaagtcagcaacaaactcgccaccaccagccccgggaaaatcgccgacagcagcgtgtctgcggtcctcaacgccgacatccgcattgacggccagcccgccggtagctgcgaggccgggcccatcccgatgaaaccgaacggcgccacgtcgatctcctgcacctcaccagaagccggcgcaacctttgccgccatcaaagcagagaaagaagcagccgccaaagccgccggcggcggcaccgtcacggtcagctcgacggccagcgcgcaggtatacgccaccgcacagaccgaggtcgaggtcaccaagaagaccaaagagttggccgccgaacagcagcaggcgcaggcctaccagtgcccggtaaccgggaaggcatgcaccggcgacccgttcaacgacctcgccgcattccgtaagcgccagggcatgccggaagcgggcaccgacgcagacaaggacaccgcggcccggctcgacgtcggcggacaaatcttctacgggcgcaacggcaaaggcaaagtcaccgacatcccggtgaacgcctacacccgcgaccatgccgaaggcgacgttttccagcaggccaagaacgcgaaaatcactgccgaccgggcggtcatgtatgtcgatcggccgctgtgcgacggctgcggcgcctatggaggagtaggcagccttctccgcggcaccggcatcaaagaggtcgtagtcgttgcgcccaacggccgctttttgatcaccgcagcgcggccatccaccccgcagccgctggattgatagcgtcgacgcctatggcatggcatttcgcagacgagaccgagccggtgacgggcattgacgcagctcgcaaactgcgggcctgcgccgccgcagggaacctggaaaccgcgctgcagcacgacgacggccgactgctggtcatttcgtcgaacggcgaccgggcgctggtgatgtcgatggatgagccgggtgatccgggccagcatgccatcgaccctggtgcgagcggagaggttggcgggtacctgctgtccaacggtcaggaagaccgccgcgacaaccaggacacgattgcattcgacgtggctgttgatctggttcgggagatggtggatcacgaccgatggcttccgggcgtgcagtggatgaacgaccgcggatagcagaggtcggggtgcggtggccggtttctcggccgtcgccgcaccccgacacgacaatcagcggtcgacgacagcgccgtcgatgatgcggtccttgacgagccggaccggaccgccgcgcgctgggcgctggtgccgcggggcagcccgacgtgggcggcgactgcgacgcacctggacgcttgtgccggccggctacgacggatccgggcaaccgatcgacggccggccctgggtgaaacgcggcaacgactgggtgctgcccgaagaaggcgctggcggttagcctgccctcatgggggcagacgaggtgacatggcgccgggcctggcagtcgaagcgcggcctgatccggctcggtgagcatgcggacggccggtggctggtgtggcgcagcaccggcaaacaccgcgagttctgggatgaacgggccgcctgcgagtacctgcaaaaggccatgagccgatctcggtgggaggaagtgaccaccgctggtaccagtcatcggccggatggcgccgtcgtgttttctagcgatcgagtagctcagccagactagttgaactgccacgccgacgcgcttcagcggggtgacgcggccggcatgtatcgaagtgtcatatggagcaggctttgatcgcagcctgccgctcagctggccggccttcctgccgcgtcgacgccgcagcgcatacctcggccgagggcacctgccggctgagcgtcatgtagggccgcgacaagcggctcgagggcggcaagtagccgctccgcctcgtcaacccccagttcagctgaacccaggtaaaggcgcggcacagtgtcgtactcggcctgcgccagttgcagaagtagcggccgctgagggcacggatctggcaactgtggaacatgcacgggagccgactcgtgcaccacaacctctccgggcgactcgtcgtggacacgccgacagaacggcggacagatcagcgacaccgggcacctccaggtcacaacggcgtagatcgagaaagcaatccaccggtggccctgccccggatggattgccttcaccatgacagccgcctatgcccgacagcgctgctgaagcgctacctgcgacggtgctggcgcgcccctgacctggccctccggcatcaccacgcccggctaggcgcgaaccggccagtagtagcaggcaaatgccggccatcaccaaagagacgacgcctaccaagccggcgcgtgataccgcatgtgccgctcccgagcagcgctcctgtcaacgccaccgctcctacagcatcccggccatccagcggcagcaacgaatcggtgcttcggtagcggcccggtcacggagcgccccccacactgatcgacaaccgcataacctggcggaccgggacgagttcccacgaaaggaaatcgcgcgaggtgaaaccctagctagctaggatggatctgctggcgcccgggtcggtgcggatcggaccgatcgcaggagccgcacccatgccggcgagccccgtctccccggcccggcccgcgcaggtcaccccgcccccaccagcggccgaggaccagccagcacaaccttcggtgactcagccgatggcgccggtgaacgctgccgccccggcgctggcggcgggatcgcatcagcagcggcctacggcgccagtaacgccggacgagatgctcaagatgacgacgccggaaacctcagccgaagtgccgaccgatcggacatcagcctgggccgccataccgacaaccagcgtccatcacgccgccaccatcgtcggctccccctggtggcggctcgccgtcgaacgcctcgcgtggatcatccaccgcgagatcacaccagacgacctgccgcgcatgacctactcccggctggctgaacagatcacctcgaccaccctacgtgtccccgaactgggcagaggcgtggtcgaggcgttcgtcaacgactacatccgcgcgatgaacggcgaacccggcaaggccacctacccgtggcgcgacctgctgccgcagccggtcaccacgccggtcggctccgaactatggaagcaacagatcggggacctgcgcgtcgcgctgatcaatgagctagacggcagcgacgagaccgacccgcgcgaactggcgatgacgctcgcgccaaccgtcccgcggctcgacgacgcaacgctctacgcgttcgtcaacgactacgtctgcgcgctcggtggtcacccggtcagcggggacccggcgtggcagcacctactacctcaccagaagcagtcgcaacgagcgagcccgcgcattcccttacctcatcgcggtgcagagggcgccggtgccggcgctcagcgacaggcggtcattgcgccagaggggcacggccagcgacgggccgctcgccggcaggacgtcgtccgggagaaagcctcgatcgctgccgccaccccccggcccgcggcggtcacgcatcgtgttccgcagccgcggccggctggcgatccccaagagcagaagctggcaagttcgccccgtgagctacgggagcaattggctgacatgatggcgtctgggcagatggagacgtgcacggaaaagtggaagcgcgaaaccgcccggcagctgtaccgcgatatcaccgccgctggcgagcggatcaccgggactgacctcgcggcgttgttcggccgcgacccgcggtggggtcagcggcgcaaggaagatgtggaccgggggcgccgcactcaggatgtagctcgcgcccgaaatcggtcggcaaccaaggagtagcggcgaggggcaattcgactcgggtcgtatccacccgccgtctcctgaccgagcttttccctcagttccttcttctgcaggccgagcgccgaaagtgtcgcttacaccgaggaccctgcgacagcgacagttgacgccgccgcctgacaaccggcggtgccgaaacgcatgcggacacaggctccggggccgacgtcgacatcggaggcgccgccatcgaaccttcccgcagcgcaactgtgccgccagaccgctaagcggtgcatcccgtgtcctgcgaatacgacactttttccgatcgaagcgacactcgggtagcagcgtctgaagcgacaccctgacggctggcgtgcttcccgtctaaagcccggtttggtacaacgcggccgctactggtagcggcgttgtcgcggctgtgccgctaccagtagcagccgaagcagcccgccaggttgatgatgctggccgcggctgcgatgcgcccgacaaagggcgaggaaggaacacatcggcgtctttcaccgcttgtcctttcgggtcggtcgctggtcggcggggtctcggtccgtcagtaacacgagatggtcgaggtcgcccgcgatcgtcgtcatcgcagtggcatccaggtcggtgaagaactggtgctccaaggcgtagttgatgtcgtcgatgatccgagcgattgccgcccggtcgggcgcagcagggtaggagcgcaggtagcgctccagcttcggccgcaggtggtcagcccaggtccgcgcgatgctggttttgcgggtgcgatgccgtcttgcttcgcggggagtaggtcgccgccaacgcacagcgcgagcatccgtcgagcgtctgcggtgatcgcgtgccgccgcgccgccgcgccgcgcgggaaaaatgcgcgtacggccggccgggttccgatgtaaacgatcgtcagcaagacggccagcatgccgaggacgatcagcaagaaccacgccaggccgcgtccgggcgtaatcgtggtgaagagccgcgaggtgtcgaggctgtaaaggtgagggctcatcgtgatcacgggctccgaagggggcgcagggtcggcggcgtcgagtgtgaccgcgcaggtcgatggtcaacggttgggtggcgctcatacgagctggcattgagggaagtggcggtaaagggtggcgcggctgacgccgaacgcgtcggcgacctcgtcgacgttagctgttcatcaacaagtcaggcgtcatgcccagtagtagcgtccggtctcccgccgagagcaagatgtagaacgggtaaccggaccgagcgcggtccacagggcgtcctgcggcgcggtcgcctaggccggcgcggtgagctccagtcgcggcagcatcaacgggtgcccgccactgtgggcggtgtggatgacgacacgaccgggaaagtgcgtggccgggaccggcggcacctgtatccgggtaggccgggacggctggcgccgcggtttaccgcagcggagctggccgatctcaccgaggcggcagcagcggcggggatgaccccgacgggcttcctggccgaggccgggctggcattcgcccgccaggcacgcccggcccggctggatccactgcgcgagcagctgcggcagctgcaagtagacctgctgcaagcgcggactgcagtagccgggatcggcgagaacctcgaacgggcggtcaccgcagccgatcgcactggtgtcgtcccgccctggttggtggacgcggtcgccgtctgccggcggcgcctcgacgcgctcgacgcggtggtggagcgggtcgacgggcgtctgccgtgattacgaagatcgcggcgcaggggcagcgggtcggggggctgctgcgctacctgtacggcccgggccggtgcgaggagcacgtcaatccgcacctagtagcggtgtgggatcccagccggtcaccgggcgacctggaacccgtggccggtgtcggaggtcgaccggacgtcagcatgctggcccggctgctggagcagccggtacgggcggggcggaacccgccgcggcagccggtgtggcactgctcgatccgtaaccacggctcggaccgggtgctgtcggacgccgagtggggccagatcgcccgggagatggtcgccggtgtcggcctggcagcagccgacggccggcccggagtccgctggctcgcggtgcgtcacgccgccgatcacatccacgtggtggcgaccctggtccggcaggacggggagacggtgtggccgggcaacgaacgttggcgctgccaggccaccgcacgccggttggagcgacgctacgggctgtaccaggtggctccggcggactggacggcgcaccggcgcccgcacacccctgaggtgcacaaggcgatccgggccgggcgcagtagcaccgcgcgggacgagctgcgccgccgcgtgcgggccgtggcggcgaccgctacttcggaatcggagttcgtggcgctgctgcgcgagtccgggctgctggtgcggctgcgggccagcaccgtcgatccggctcagatcaccggatacgcggtagcgctgcccggccggggcggcggcagcccgccggtgtacttcggcggcgggaagcttgccgccgacctgacgctgccccggctccgggtccgctggggcatgcccacgccggatgccgggccgccgcggccgccggtggaccgggctgctcgagtggcggcgctgcatcaggcggcggccgcggcgcagcaggctacgcaggtcgtccgggatgggctgggtgccgggcaagcggcgacgcaggcgacggtggcggccgctgcggacctgctcaccgtgctagcgcaggccagcgaaggtgaccggcccggtccgctgcaccgtgccgccgagcattttgaccgcgccgcgcgccttcgctgcggccggacggttcccgccgacggccggtcgcaggacctgcgggcactgtcccggctgatcgccctgatgggccagatctccggcaacccggaccggtccgcagcgctggccctgactctgaaactggcgctactggccgacgcggtcgaacaactccgcggcgcgcagcaccggctgcaccaggcgcgggacgcgcgcactgccgcccgggcgctacgggctctcgcccctgccggggccggccgggtagcggcaccggcaacggtgcgccttacaccgatgcggacagtcaacgatggctggcggacacccggctgaggatcagagaggaggtgagcccatgacggatctgacgcagcaagtacacgaggatccgttcgcggaaggccggcagagcatgctgcaggcgatgagtgcgctggtgacggtcttcgaggcggcggcccgctacgcggcggtcggcgtccaggaccgtgctgccgaggctgagcggcaggcccagcgtgaggaccaggccgcgcggatgcagcagcaagccaaccggctgcgggcagcagaacagcgcgagacggaccgctacgcccggcagatcgctgaggccaaccggccgctgcgcgagcgcggcacgttgttcgaagcggccgaggcgtggcggtgggggaccgtgcacggggacaccccggtcggccggcagaccgccgcggacgcgctgcaccggctgcggcacctggcgccggacctcgtcgacggatacgagcgccgatgccgggccggcgtcgctccgcacgaggcgatggcggacgcggccgtcgactggtgggagcagcagcatgccgccgagccgcagccgggccgcccgtcccgtcgccagctgacccacgttccggacgctgtcgacgagttcgaccaggcggtccgggcgcaggtcgccgtgctggcccgcgacgtcgacccggccgcggtagcggcgtttcaggcggatttgcggcggcagaacatggtcgccgctgacgggctcgacctgctgctgcagttcaccgtcgagcaggcgaagaccatgcccgccgataccgagctcctcgtgggacgggcgatcgaaagggcctatcgtgccgacggccggaccgctgccggtgcgctggaccggccagcaacggccgccgacgagcacaccgaagggcaggtggccgcgaaagtgctcgacgccgacgcggatcaggtcgccgcgagcatcggccgccaccacaacgccagcggatccccgcgagcggtcagcgcgcaagcgttcccgccgctgcggctggccgccccgggcgcccagctgcggccgacgcccgccggcgggccgggacgagcccctcaccggacaggaccacgccgatgaccaccacgaaccgggcccaccccgccaccctgtttgacccggtgacccccgaggagccgatcaggctgcccagcgaaccggctggcccggcgcgcgatatggaaccggcgccggccgcctcggccgccgcggcggctgtgccagccggggaggagggcgcggagccgctgtactccacggtcgaggagtgggtgaacacgtacctgctgccgaccttcccccgcccggtgggcgcggtcgggatgacccgctggtactggtgccggcagtggtggcgccacgaagaggccgtcaccaggctgaccgcgctctggtacgcgtgggaaagcgcccggctggaggtgaccggcatggtcgggtggcttccgttgctggatcacaacctgccgctgctgtgcggcgaggacggcccgttccgcggctgcaccgtgggcaagaccgccgacaccgcccggcacgaactaccagcgatcgccgccaccgagacggctcccgacggctggtggaactggtgggataactgaccctcatggcctgatggcgctgtccgcacgcgcggacagcgccatcctttcgcggttgctgcgtcggcgccgaggtgtcggttcctggaccgactacatcggcgcggctggaggcgtcaggccattgcgtcatcagggtcctgccggtaccgtccggtccgctggccccgaacgcgtcggccgtccacgctgcgttcgcacgtttcggcgtgggcggtgaagtgttcagcgccgagttgccgctcgtagctttcgacgtccctgccgatgccgacttcagtgagatccagcaggtactcacggatggcaagtcgcacggctggcggcactttgaggtgggctgtgggactggccgttggtggaactcggcggggcctgagcttagccgtggtcttcccaatcttcgacgccgaatcgggcttcgctgatcacgacgtcgccggcccgtgccgcccggaccaacatactcagatcgagcggccctacgtctccgttgcagccaaaggccagggttacaccttcgttgcccgcatgctggtagagggtggcttcgagagcaggaatgctcttgccgatcagatcgatgccgtcgtaggcgacctgtgggccggtacgcccgtgcacggtgacggccgccagcgaggggatgtcccagccctggtagtgggcggtgaccccggtaacgtcgaatcgctcctcgctgggaaaccactgtccggccttctccagcagcggcgaggggtagtaaccgcggcgggcagccggcgcttcgccgcccaacgcggccgacacctgcaacggggtcatcccgaactcgagcggtcccactgccttcaacggcgtccagtcccagcgcgcacggctctcctcggggatcacgagccatgccccgggatcacattcccatccgcggacatcgcgccatctgatgatcggctcggacgaatacggatcctccgccaactcggcaccgacgaacagcgcgtcggtgaccatcatgccggtgcgttccaacgctccggacggcgaaagtccccactgcggcgtagcgcccagggaaagcccccaggccgccacctcaggatcaccgctccagttcacggtgacgacagcgtcgtcgcggcccgcgagttgctggatgccggctgccaccgcggacggcttgccgccgacgaggtccagttcccgcagccggaccatggggccggccagcgcgtcgatcgccaccgcgacgaggcctccctggtcatagatcgcggttacgccgccatcgctgtaccgctgccatgactccttaccttcgtagcctcgatacgattccaaagactcagcgcctagaactgctttgacctgctgtgacgtcatcccgaaccgtaggggtcccacgccttccagcgggtcgaaagaccacgtggcgcgatctttaggtttcctttgccaccagcgcatacttgtcccccgctaccctcgccaggccggcatcagcgccggtcgatcgtgcgaggcatcctaggcgcgccctctgacaaaaatgtggggccattgagggagtgcacgaacggatttcatcgccgagaaccgagacggcggccgcccgtgacggcgcccctcgacggcttaccggcggcgcgtcgggtgcgttgcacgggccgttgcgggagacggctgcgacgcgaccatgccgcgcggacgtaagggtggaaaggcgctttgggaagccggaggtgccggaccggcgctgttcagcgttccggcggcttcggaccaggacgcttcgacatagtccacggcgatctcgacgagggcctggacgctgatgccggtgcgctgggtgatgagtgcgccgatgcggatcgcttcggccttgtcgtcggcgtcgaacatcagcgtgaccaggtgccgggcggtttcgacgcggccgccgacgtcgtccagcagccgtggattgcggtcgaggagggtgtccaggcggtggttgacgacggtttccagcagcggctgggtgtgtgcctgcagcgtatcccgcaggtcgacgcggccgtcgggccgggtcagtagggtggccgggtcggcgccggcgggcagtacggcatggtgcagcagccgggacggcagccgggcgtgcagcagggaccaggcgcggtcggtggcggcgcgtccggcggggtcgttgtcgtaggcggtgaccacaccgtgctgctgggcgccgagcacggcgctgacctgctcggcctgggccggggtcagcgcggtgccgcaggcggccaccgccgcgatgccgcggtcgccgtcacggctgtaggacagccagaccgccagcacatcggtggggccttcgaccagtgccggctgccagccggcctgcagccggtcctgttgttcggccaggccgaacagcagctggctcttgtcgtacagcggggtctgcgcggtgttgaggtatttcggggtgtcgggtccggcgccgggggcggcccggccggtgaagccgaccgggccgtgctggtcgcggaccgggaacatcagccggtcccggaacacgtccagcagccggccgggatcggcgtgctgacgccggcacaggccggcggcgaccagctcctcggcggtgtacccgctggcctgcaggtgccgggccaggttctgccagccgggcggggcgtagccgatctgccacggcccggcccggtcgacgaccggctgcaggccacgctgccgcaggtaggtgcgggccgggccgccggccgggccggtcagctgacggcggtagaagtcgaccgctgcgcggaccgcgacccgcagccggaccggatcggcggcggaagctggaccggcggtggtcacggccgatcacccccgggttcggcccgcgcggcgggcccggtcgtggtcgtgctcggcggccccgcccgcgccgtcgtcgtccgggctgcggccagtgcggtggccggtgtgcccggcgcggtcggcgtaccgggcgcggcgtgcggcgcgtgcctgcccggcccgccgggtcatgtccgcggtgttcgcggcgaccgccgtcgacagctgttgcgcttgcgggccttcgtaccagggcagcagggtcagcatcgcgacccggacaccggtggccagcagcagcgccgtgcccttgggcagcgcccggatctgggcggcttccaggatccgctgccggcgggtggacacctggtgggaggtggtgccggagccgtcgcgggtgcgcgaagcgacggtcacctcgtgctcaccgacgagccgggacaggtcttcggcgaaccgggcgtcgtcgatgccggcgccgacgagtttgacggtggccgccgaccacagagcgtccatgccgcgctcaccccacacccgggcgccctgccggtacgactgcaggatcgtgatcgggcagatcccccgggacccgaagtgcgagtacaggtccggcaggtcccggatcttgcagatgttcgccgcctcgtccagcacggccagcagcggcgggtcgagccggccaccggtggcttcggccagggtgaccgcggcgcgcagcacctggtcggtgaggccggcgaccagcggcgcggccgccgcggcaccatccttggacagcaggtagagcgtgtcgggggagccggcgaaagcgtcaacgtccagagagcgcagccgccggtcgccgggggcggtgacccactgcatgatctccgggttggccaggcacgcggccgcggtccgggcggtttcgtaaatgccctcgcgggtttccggggcgccggcctgccggccggccagggcccgggcggacgcggcgaacccggcctgctccaggagttgcccgggcacccgggtgatcgagtccgacagccactcctgcaccgcgtccagtccggccccgctgaccgcggcggccaggatcagcgaggtcagcaggtccagggcacctttggcccagaagtcgtcggaaccgttctccgcgcggatctcctgaatgaagtggtcggcgagccgctgcgcgtcctcgaccgtttcaaccgcggcgaggggattccaccaccaggtctgctcgacgtgggtgatgtgctgcgggtcgaacgtccacaccctgccccgtccggcgcgggcggtggccgtggtcgcccacaggtcggccttgttcgaggtggccaacgccgggccgggcgccgacaggaccgccgtgaccgccagcgcggtcgtcttacccgagcggggcgccatcaccgccagcaccacgtcttcccacgacccgtacacgcggtcaccgcgaccgtgccggcggcggtgctcgccgagcagcaccccggccgcttcctcggccacctctttgaccggagtctgctgcagcgacggacgcagccggcgggccttggccgccgtctgcgccagactcatcggagcaacctccgcccggctggcgagcgcgggcagcggatcctccgcatcgggccggaaccgctgccagaccgctacccccacgctgaccagcacaaccagcgccagtagcagcaccgcgtagacgaccgctactaccgtcggggacacccccggccacagccgcgcccaaccggcatgcaccacaccctgggtgaaatcagccccgaaccctggcccggccggccggccggtgaacaccgcgaccaggcgcccggccagccagcccagccacaccaccacccagccggccgcgcacaacccgagaaccacccacggtgtggtcgccccaccggcgttaccgcgcggctcgaccgggcgcatcgacaccatccccggccccgatcagatccgcccggccacggccgggcgaacgtcacggatcgcggcgtcggtgtcgtagagcggtatctcctcgtcgaccagcgtcatggcgaccggcaggcccggccgctcaccggttttgatcaaatatttgccgcggccgggatgcgctgccccggtgaaccaggcttccggcgcggcccacgaggcgaccaggtcctgctcacggcccgatagccggaccacgtcgttgacccgggccagctcccgcggcggcagcccggccaggattttgatcgcggcccgctcgatgaacccctgcgccttagcccggtccgcttcggtaggcagcgcgtccaggtcggccagggaatgcgtgaccatcaccgacgccatccccttctgccgattcaacctggttagcgcgtcggcgtgctcgaccaggccggacgcgccgcgcagcgcccgccacagctcatccatcaccccgaggtactgccggcgcggcgccaagccatgatcagcgagggcggcggcggcgtcgaccatcgcgtacccgtagctccaggtgcacagcatcgcagccgccaccagctggtccccggcggcggcgacctgcgagatgtccacgctgaccgccggcgcgtccaggtcgagggcagtgctggtcggcccgtcgaacaccccgcgcagcgacccctcgcacagcaacgccaaggtgggtaccagctggtcgacgcggcgccggtactcaccctcagtccgggcccgcgccgccgcccgcagctcgtcggcgccggactccaccaggtgcagcacgtccggcaccgtcggatcatgcggcaggcgttcggcgaggacgtcgatcgcccggcccaggatcacctcctcggtgttcgacagcggaccgccgcgcaccagcgcgcacagcgcgagcagcagcgacatgcgccggccgcggacctccaggcgcagctgccgcgactcctcggcacccatccggctcaggacggcgcccaacggccccgagtccagggggttgatccggtccaggccgcggccgacccggatcacctgaccctccagatgccggaccagcggggtgtagtccggtttggtgtcgcccaggatcagggtgtgtgtgccgcacccggacatgccggtgaccaggcgcttgacgatggtggagttgtgggtggcgatgaaggcccgggtgaccaggaactggccggaggggttggcgacctggatgcagcgcaccggccgtgagggcaccggctcgacggccacgatgtaacgcaccgcggtccggagtgtcgcggcccggcgtcgctgccggtgggcgtcacgtttgcgggcgagtccgaaaacctcgtcggtggtggtgaagccgatctgataggcgtaccggtgtgcggtgacggtgctgccggttgcccggcggttcatcgccggtcggtagcccagcgacgcgatcaggtcgaagacgtcctcggcgagccgctggtcacagctggtgtattggacctgcccgccggggctgaccgtgccgtcggtgtcgagcagcccggacagcagctgtcgccgctgctcaacgctggcccgcaggtattcagcgggaatgtgcttgtcgcccaggacgccgagcgcgcgcagctgccccaccagagtctgcgcgtgagcgcacgcccggtgccgctgcccggtgctcgagcggcgcaggggctgccggcagtgctgacacgtccgggcctgccggtggccggtctgcggggcgcgggccgcgcacggccgggaacagtactgctgcccggtgtaggtggcgtcgaacggcttccggcagcgccggcagacaattccggctggtggtgcgggaaggcgctggctgctgatgctgtaccggtagcggcgcccggcgagcacccggtagccggcggccgagaactcggcggccagggccgggtcggcggtggtgaacatcgcccggtcggtggcgccgtcgcccagccacagcccgagcagccgcgccgggacaggcagcggccgatcatggcctgataccggcggcgcaaccggcaccgcatggttggtcttcccggcgtgcgtcagcgtctgccggatctgcctcgtggtcaccgtcccggtgtcttcacgctgatcgttgacgggggcggcgagcatcagcgcggtctgctgcagggtgctgtaccggtcgaacaagcgggcgttgccggcgcggccggtgaccggccagccggtggcccaccggtacagccggtcccggaccgacggctgatcccagcccacctgcgcggcaaggtccggcagcgtcgtgtcctgcccgggcgtggccgcggccagcaactcggcgacccgggcctgttccgccgcggtgcccagcggccgacgcgccggcggccggagccgggccactacccgggcctgccgctgcgcctgggtttgggtgacccacagatgttcgtcgtcagcgaccaccgtggtggcgtcggagaaccgcagccgggaacacgtccggccggtccacacctcggacaccgccaccaccgtggtcggccggccgtgctcgtcgaacaccgcgtcgcccggcttcaggtcacccagccgggccacaccgtgcggagtcggcaccggcgtgtcgacgtccaacgccttgccgacaccgggctgtccgagaacgaaaacacctgggttggtgaccagacccgcgcgcagccattcgagcgggtcgaggcagacgacctcgccccagagcatgtgccggccgatcggcacgccgagagtgggggcgccgctgccggcggtgaacgggaacagcccgcacatctgatgggtggtgccctggtactccatgccgggagcgacgtgtgaggcgcggccggcgtgggggccgcggtgtccccacgacggggcgatgcggacagggttggacggcattgtgcctcctcaggcagtgaacggggtgtcgaaggtgagcaggcggtaggtcatcaggcgggtgttgccgccgtcgttgccggtcgcgctgcccggtagcggtgcctggcgggcgctaccgggcgcggtgccgctgctggcccgggccggttgccggcggcaacccggcgggcatgctggccggcgcggggaaggggacggcgcgggccgggaacgcggcggccgcgctggacgtgggccgactggtcaggtcgacggtttcggtgtaggtggttccgttgcgccagccgacgatccgcgatgcgctgacccgggtgttgttgtacggccggtgctcggcggccaacttgcgggcttcctcgacggtggccacggtgtaggtttcccggccgcgttcgctaatcgcgttggcgaagtccacttcgatccggccgaccttggaggcttcgatctggcgcagcagggtgtcggcggcgcccgggtcgtaatcggggccgggcaggcccgggatgcggggcacgtgctcgcggatccaggcgaacgcggcgtcgcggcgttgcggcaggctcagcgacggatgcagcagccggcgggcgtcggcttggtcccggtcggtgtaccggtacggcggcggcatccaggcggtgatctccacccatgacctgtcgggcagggtggcgtggccgcccgggttatcggtgacctggcggtcgccggtcttccaggtcacggcggggtcgagcaaggcggcgtgcaggcggggtaggaccagcgcgggcagggtggcgcgtagttgccggttgcggctgttgtcggcggcggtgaacagctcccactgcgggtcgccgcgcggcacggtgacggcgagggtgaagtgggcgttgaggacctcggcctgccggggcgggttgccgaacgcgacggttcggctggtggtttcgaactggaacgagtgcgagtctgtctcgaatcgccagccgtggtgggggccgtcgtcggtgatggtgtacgagccgatcatcgggtcctcccgagcgggtgctggctggcggcggccggtgcttgcggtgcccggtgcggtgtcggggccagcggcgggaacgccgtggccgccggactccgggtgccggtgcggatccggtcgtggtgcagggccagggtgttcgcggagatctgccactgccgggcggcggcccggaccgggccgggctcggcggcggcgaccagcacgaattgcgggcgggccacgccgtcgtccgggtaggggcgcagggacgccatccagcggccggcggccgggtggacggtgagcgtccacgacccggccgggacctgtttggcctgcacaccgtggtcggtcaggaacgccagctcccggttcacggcgaacgcggccgggatagcggtcatcgccggggtcccggtgtgggtgcgggccgggacggcggcgcgaccgctggccgtgtcccgggggtccccgggacgatgacggcggggcgagggaacgcggtcgcggtgggttgcgcccgcttggggctgtcggccggatccagggtgatgggccggatgatcggcaggccgtggtcgatggcgacgacctgctcggcggtgaccgcggtgttgttgaacggccggtacgagcccgccatgatggtcgcctcgtggagcgtgtcggcgacccggtgacgaaggccgtcgccggtgccgttgcggaaggtcagcacgatctgcccgacgtgcggctggccgggtagcggggtgcgcaggaacgtgtcggtggcggcggtccacgccgtgcggtcttgcccggccggcagcgcctgccgccaggactgttgcagcagccaggcgaaggtagcggtcagcccatcgcggttcatccggtccccgagcgatatgccggaccggtggcggcgaaacgaatcggccgcggccacctgcacggtgctcgccggtccggtcaggtcggccagctggccgctgatgcccgcagtgatcgacgatgcccggctcatcagccagccgtcccggaccgccagttgcgcctgtacacggggtagtagcaggcccagggcgatctcccggatctgccgggcggtgggggtgttttgctgggtgcggccgaagatccgcatgacctcccactgcgggtcacccggctccaggtgcaggctcagggacacccggggactgcccggcgcgctgtcgggcaggttcggcggatgcacggtgatcgtctgcgacagcagtcgcaggccgatggccgcgctgtagtgggtgccggaccagccgcgcagcggcccgtcgtcgatccggaaccgcagctcgctcatcgggcgcgccgctgcgggatgcagccggccgccgggctcggtatcacggccggtgccgtcccgggtgccggccgcagccgagggaatgcctgcccgctgtggtaggcctgacccggcacgggatcggccgggccactcggagccagggcgtcggccaccgtcgcgagcaccgcggaccgcggatcacgccggctgagcgagtcgcggatcagcagcaggctggtgcggtgaaagcccaggttgtcggtctgcaccatgtcgcgcaggcccgccatcagcacatccggtgcgtagccgaccggccagccgtcggggaccaggggcggctcgttgcgcgcgtagtacagctcggcgagcgtctgcagcaggtcggcctgcagggtgcgggcggcggctcgcttaggctgcgcaacggccagtcgccgatggatgtgggcgagttcggccagggccagcgcccggttcaggtcggtgcccgcgccggccagctgctgaagggtcgtggtagtgcgctggttgaggacgtgcaccatgccgttgcggccgccggcccggtagccgctgggggcgcggctcaccgggaccgtcccatggccgggcgggtcgcggcccggccgagcgcgacaccggcggccgcgaacgaggcccgcgggtgcagcggcgggaaaccctgcccggcggggcgtagctgcggacgtaccgtcccggccaacggggccgcgttcggtgcgggcaggtgggcgcgtagctgtgctactgcggtcagcgcggggtcgtgcgggtcggcagccgccagcgtgctggcggtctgggccagcagcgctgcctgttcccgccggtctgcggcgatcgtcatggcctgcagcagcctgcggaccggtggggtgaaggcggtagccgggcccgggccgggcagaaagtatccggcgcgggtgtaatagacgtgcgacagggagcgcagcatcgcgatctgccggtccgagcggccggcgttgtcggggtcgaggtcggtcagtctttcggtggtgcgggcagatcgggccagcaggtcggccagggtggtgtcgtgcggctcggcgcggccggcgcccggcagtagcgcggcaccccgatcggtgtgggtgggtgtggctggcgcgaaacgcgcccgcaggcgctgggtgaagctcgacaggacgcccatgacatctccgatcaagcggactggtggcgcgggaaggaaggggcggtcagcgcggccattgccgggccagctgcggcgggcaaatgccgcacggcagagtggcggcgaagccggtggactgcgcggcccgctgccggcggagccggatcttggcgatgtcggcgcgggactcgacgtcggcgacggcccggcccaggtcgtccggatccaggacggtggtggtgacccacaggctcagcaggcccacgccggcgccgacggcttcctcccgggcggtctgctgcgcccgttcccggtcggccaggtcccgggcggtttcgtcgcggcgcttcgcccggttgtaggcggcccggaacacagccgcgttgacctcggactcgacggcccgggcggcttccccggccggcagcggccgatacagcagggtgacccggcgcgggtaggcgcccggggccatcagccgggccaggacgtcggcgtgcaccgactggcggggagcctcatgccacgcccaagagacgctgacgccggagtcgtggacgtaccggtcgatgtgctcctcggcgaacaccggcccgcagctgctccagtcgacccaccggtccagatccagcggggacagccgggccaggtcggcgcgggcggccgggtcgaacgcgccgcgcacggtcgcggccagttgcgccgtggtggcccggcccagcacggtcagcccgcaactgccgagcgcgtcctgcagacctggcagggtccgggcgatctcctgcagtgcctcgtcgatggtgcgcggccgggccggggacgcggccggccggaacgtgatcgtcacccgggtttcgacgtcggcggccgcggccggggacacctccaccaggcggcgcaggacccgctgggcggaggccgggctgtgcggcatgatccgccgcccgacgtgctcggcgagccgggaaccctggtcggggcaggtgtctacggtgaccgcgacgtggtcgatcatcggcaggtagccgaggttggcgagccagccaccccatgaggccacccacgtgtcggtcgtcgacgcgtccgccagccaggtcgaggtggccgcgcagcgcagcgtgacggccatggtgcccagccgctgatggtgcacgaccccgaagtcaccgccgggatcgtcgaccgccaagagccgggtggcagccagcaccccaggcagctgccatccgtggtccccggtaacggccgggccgctgtggtagcgggtgtagccgcgccgggacccggcctgccaccgcacccgctgcgcgatcccggccgccagtgaaaccccatcccagcgggcgaccatcacgatgaccacgatcagggcgggtggtgcggtcaccgccagcagacccaggctcagcgacccggaaatcaccatcgtgacgaccgcgccgagcaccaccacggtctgcaccgatccgagcccgaaaaggcccatgcccctggaccggcgccaccccgcatacgtgcgcaccggttcggcggtcaccggtcaccgcccgggctggtggccgactgcgcggtgttgccgacggaccgggccgcggccccggccgcctgcaccgccatcgctagctagctagccccggccgccggcccggcggacatgggcatcgggctcggcgcgggcgcggcaccgctcggcgcgggtttgcccgggccgttgctgtccaggtagcgggcgtgttcggcggcgctaccaccgcccaggctgcgcatcgacgccgcggcgtgcaacgcggacgcgccgccggaggccgcggtggccaggccgccgccaccgctggacatctgcccggtgaagtgggtaaagaacttcatcagcgcaggcatcgcgacgatgctgacgatcagcatggccaggccggtgaacctgtcccggcccgagtcgctctgcagcagcttcgcgtccgcagcgaagatcagcacgacggcaggcttgtaggcgatcaacgccgccgaccagctgaggttgcggttcaaccagccgctggtgatcccggtggtcttcccggccgcggcgaactgggtcgtcccggccaacaggatcaccccggcggtgcggaaagtcatcatgacgaccagcgcgatcaggaacagaatcatgatcacggaaatgaagaagccggccatgcccgtcacctcaggtgaatcggcaaccatcgaggtcagcaggtgctgcagcttctcgttcggtgccccgtcgccgggaatgctttcgtcgatcacccagacgcagaatccgtcgctggccttgagcagcagatgcgcgacggccaagctcaggccgccccacagcacggtgctgatcagcccgcggccggcctgcagcagcggttcgcccttacgggtcaccaccatcatgattgcctgccagatcaggccaatagtgagcgtcagcccggtcagcggcagcatcagatgctggatgctctgggcggccgatgcggtgctgttgcagttctgcgcccagttcggatcccagctggccggatcggcgccgttggtggggcagatattcgcggaggtggtcaggatccaggcggccagcgacccggcgagataggccaggcccttagcggcctcacccatcaagtagtcgagcacgaaatccataacgatgagtcccttgacaagggatgcacggtggccggcgtcctgcctgcaccaatcacggcgcaggcgcgcggcgccatccgcggcatccgaaggtggcggccgagggccgggacgagcgcctacaggaaggcgccgacgatgacggcggacatgccgccgagcatcagcccgccgatgacccacggaatgccggcggcgccgtcagaggccatcgcggaccggttacgccggccgacggtcatcatgatcccgcaggccaccaggccaccgaccccgcaaaggatcaggatccacttcatgtagccgacgatctgcggtccgagggtctccaggccggggaccggcttcaccggggtgtccgggacattgccggcggccaggacgtggtcgagcaccaactgagcgttcactttcaactcctgcaagcggtcgtgccgtccccgagcgggacgagcaccgaccacattcggcagggggtgttgtcgctggtatcgccgctgccgctaccgccgctacggtcgcgctaccagccgccggcagcagcggtaacgctgctacccggctgcgagcgtgccctcatgaccgtgatcatgtgccgcaccgggtcggcattgccgtcgactgctgccggctgttccgccccgtcgggatccctgattcccggcccgctcgcaaggtcggcaggcccgcgatgagcagccgatcctcaatgtgggttgccgccgccggagccgccctgctgctggccccgtgcatgctgctcggcattgggatagctggcgtcgccgctaccggcgcctcctgcatggtgagtctgccaaccggagccagctcgtccaccaccgcgaccgcgagcactgcgtgggacaacgagcaggtaggcaacgcgagcacgatcgtggccgtcggcagccggctgcggataccccgctacggctgggtgatcgcggtcgccaccgccatgcaggaatcgagcctgcgcaacctcggcgacctcggcgcccacaacgaccacgactcgctcgggctgttccagcaacgcccgagccagggctggggaacccccgcgcagatcatgcagccggagtacgcggccacccagttctaccagcacctgctgcgggtcgacggctggcagacgatgaccctgacccgcgccgcgcaggcggtgcagcgcagcgcctacccggacgcgtacgccaaatggcagcccgacgccgaacggctcgtcaccacggtcaccggcagcagcggcgccgggttcggctgcgccgccgccggcggcaccgccgatgcagtgttccgcaatcccgacggctcctatccgccggaaccctgcagcatccggcccgatccgaccaccggccgcggctgcctgacgccccgcaccctgcacctggtccaacagacccgcgctgccggcttcccggcacccagctgctgggatcagcgcagcgaaggcgagcacccgctcggtcgggcctgtgacttcatgatgacctccggcggtgaagccaccggagccgagaaagcccggggcgacgcgatggcggcctgggccgtcgccaacgccgaccggctcggtctcaaatacgtgatctggttccggcggatctggacccggcggaccggcagctggcagccctaccagacgatcgccggcaacgatcccagcggctggcacaccaaccacgtgcatatctccgtcgaatgaaccgtcgcatttcatcagatgacggatccgtgctgtccaccgctgcctacggacgcccgcagcaacccccgactccggcgtgaacgcccttagccgtcaggagagaacgccgtgaccgaccctgcgccgcggaccgtcgagcagatacagctcaacgactacatcaccacgaccgacaccagcggcgaccgtgcccggccgatcgccggatacgtcgccgagcgcaccggcagcgccctcaccttgtcggcctaccccgacggcgagggcctcaccaggacggtgactgtgcagcccgacaccgtggtgacggtcggcgtcggcctggcggtcgaggacgtcctcgtatggaaagacccagtcaccggcgcgccggtgaccgacccgagcctcgacgcgctcgccgcgggcacggtcctccgcgaccgggaacgcgcgcaccggatccgggagcggatcgccgaggtcaacgccgccgccaccgtcctggccgacggcgtgtcccggctcgccttactgtccccggttgcccaagccgagctgcgcgtcgccgtcgaggcccacggccctacctaccggcgcaacccgatgctgcagcccggctcggggagcatcgactacgccgcgatcggccgctacgtcaccgagggccacctgcgcgacctggacgcccggtacggattccggctggtctgggaagcggtcgaggaatacgcccggcaagcccaggaccgcgagcagatcctgacccgcaccccgcagcagatcgcaacgcacgccgagcagcggacccggcagtgcgccgagcacgccgccgccgcgggaacggcgatgacggccggtgactacgccgccgcctactaccggattgaccagggccagcagatctatcccggataccagcacggggcagggagatacacctggaacgagctacgcggcaaagtggccgcccgcgaactggccgccgtgcagaccagcacccccgccaaccccgaccagcacgccgagccgacgccggcggacacaccgcggcccacgatcccagggcttgactgcggcggtcacgatgagccggcaactgaagccccgacggccaaccccgcccccgaactacccgctatcggcatcccgcagccggcagccaccccgggcggggaggtccatgcgtcgcaggccgccgccgagccggacgccacgagcccggcaccagtgatcgacggcagcacgcagcatgctgcggccgaggcggacccgcccatgccggcgccggtggcgaccagcggggtactcgccgagttcgatgccgtgcagcaggcccggatccgggtcgcggtggaagacaacgccgggcgatacgccggcacgccaggaatcggccgaagcccgggtgcggtcgcccggtacatcggcgaatccgccggccttgccgacatcggggccggtgaccggtggaaacgcgtcgccgccgcggcccgcgaaatcctggaacgccggcccgagctgatggacctggacaccgacgacaagcggacagcggccgcccgcgatcgcaccggcgccgtgacccgcatcctcgccgccatcgacgcggcctacgccgccggcgacttcacgcgcacgctcgccctgctcgagcgcggcgagctactcgacccgacccaccggccgaacggcaacaacacctgggaacgcctgcgacagttcgtcgccaagcgacaacgcgcggcgtccccgcctgccgtaccgggcatcggccagccggagcccagccccgtcgcggccggatccgcggctccggccgcggtagccggccaccttgacccggcgccgccgggtaccgccaagcaggcagcagacctccaaggccgacctgcccagcgtgatcaggcgcccacggtagacgccaccccaccgcagcagtacaccgccgcggcgccaaccctaggatccgccgagcagccctctgacctgaccacacccccggcgaaggcccccgtatcggatccccaccagccgatggccaccaccgccgccggcagcccggaacagctggtaccagccgtcgacccgcacaacatcgaagacacggcggccgcacgacgccagcagatccaggccgtcgccgtcaaccgcggcccagccctcgacaaactgctcgccgagatcgggaacccgcggctggcgcagccagtggtggaggacgacgcccgccgatacgcgctcggctatccggccgtccgcaaaggccgcggcgactactcctgggcctgcccgatccccgactgcgacaccgtccgcggcgacctgccgagcatgcgggccacacggtcgatgtggctggcccatgccgaagcagcacaccccatgtatagcccgagctgggacgagcattcctggccggtcaccgacctgcggcaggacggccgcaccaccccagccccgatgccacgtatagacgacccggcattcggcgtcgaccgggcacgccggagtaacccgtcagccttggaccttgagaccggcgaaccgtcgatacccagcagcttcgtcgacctgagccccgaccaaatcgccgcactggaacgcgccggcgacgtgctgggcatggtgtacgggatcgtcgtgcaccgtgacgccggccgagcgatggtgaccggcccgttcatcaacgccgacgccgcctggtcctggtggcacgtgcccaccaacagggccgtccgtcaccacaacccaacagtgatgttcaccctgctcgcccgagctgagcaggaacagcacccgttgtacctgcaggcggaagccgacgagatcatggccaccgccgggccgggcagcgaccgtcgtcaggtgacctgggccatcggcgtcagcgaagccacgtatgccgacaccatcgtgagcgcatgggccgccacataccccggcttccagccgaatcccaacgacggaggcacccttcgcccgcgaggcaccaatagggtccgctgggcacacctcacccccgaggggttccggctcaccgcagacgagaccggcaagcaggaactattcaccgccacctggccagaaatccgcgcccacatcgcccgggaccggctgccccacaccacggtccaacggctggaggacgcctacgcacagcagcaggccacccacaccacctacgacgatccgcaccagcacgaccctgaacatcaagcgctggaggaagccgccagccgcgaaaacgaggccgctgccgcagccgcatgggccaccgttcgcccatccgacaccaccgaccggagacgagtcctgccgccggccgccccggcccggtctgcgcgcgaggtggcagctcaaccccgccaggtagccccgggactggcggtcgacgcccctcccgccgactacccggcggcgatcaaccgcctgcaaactgtcccgaataccgagcagctcggccgcgcgcctatcgacgaggttgccaccagcgcctacgtgcaggtgaccggcctgctacccgacggacgcaccacgacgttggccggctacctcgttgacgtgcaacaccactacgacggctgggcgggctgggtacccggtaggcacgcgctggtcaccctcgctgaccgtccgagcgccctgacaggcgtagagatcgccgtcgcccccgatgaacaggcaactgtgctgtccgcgccggcgggcatgcccggagggacctatccgtggcagctgcccagcccgctggaccgggttatcgccgcgctcgccctgcagggccgcacgctgcaaccggtgacgacgacttccgggccgggctggctcctgcccgacgtcgaccatccgttcacgggcgacaacgcagccgcgaccatgctgcgacacctgacctcctcgtgggggcaacggcacgccgtgcccgtcctgcggcaagaactcattgacgccgcggtggccgagaaccggtggaccggtcccgacccggctggccccaccccgctgcaactcaccccctccggcgcgcacggcaccgttaccggcctggtcgacggcgaacaccacaccgtcaccggcaccctgcaatggatcaagccggacagtcccgaccgcaccgggctgaccaccaccgtcaccgcgcagatgcgcatcgacgaccagcaggccgcggcgctcggcatcgatggtccgtcgcgggtcatcgccgtgcacgtgccagcgagcgacgcaacattcaccatcgagcgccggccgggcccggtcagcacaccacagcagacctccggtgctgtcaccaatcacagcccggacggccagcaagacctatttgccatgctgtggggcggacaaccgcagcaatcatccgacgagagggcagggcgtgaaccaatacggtcgacagatcgagcagcactggcagaagtacctgccgatccagtacgcacagctcagcgccccggagaccttcttcgccgagcaaggagagagcgcggcggcacagattcagaacttgacggattcgctggccgggcaggatccgccgggggagagcttcatggccaagctgggccggatcaacatggcacggacgaacgccgaggacgcggtgatgcgggacatgctgccgccgcaggagaccaccacgacctgaccggcccggccgccggcgggcaaccgccgcggttccggccgggcggccagcacgacctggcgccgagcggcgagctcgcccggatccgggcgaacctggccgcgctgcgcaccctgcgcgccgtccaagcagagcagcggcccgcaaccagcgacgaacaggcgatcctggctcgctggtccggctggggcgcgatcccggccgccctggacgaccagaagccccagtacgcgtgggtgcgccaggagctcgcgcagctgctcgacgagcgtgagatggccgcggcgaagcgcaccgtcatcaacgcccactacaccgacgcagcactggtgcaggtcatctgggacgcggtgaccgacctgggcttcgctggcgggcaggtcctcgaaccgggctgcggatccggcaactttctggccttcgccccggacgcggcgacgctgaccggggtcgaactggacccgagcaccgcggcgatcgccgccgccctgtatccgcacgccacaatcctggccgagtcgttcgccgacacccgggtggccaccggcggtgtcgacctgaccatcggcaacgtgccattcggcgccgtccgcctgcacgacaaacgcgacaacggcggcaaccacagcattcacaaccacttcatcctcaagagcctgcgcgccacccggcccggcggtctggtcgccgtcatcacctccgcctacaccctggacgcgctcaacccggccgcccgccgcgagatccaggccatgggcgacctggtgggtgcggtgcggcttcccagccgcgcccacgcgaaagctgccggcaccgacgccctcacggacgtgctgatcttccggcggcgcggcgaccacgaaccggcagccccgttcacctgggagtacacccgccaggtcgacgtcgacgacgtcaccctgccggtcaacaactacttcgtcgagcagccacagcgggttctgggccggctcgcggccaaggacggcctctaccgcggcgacgaactgacggtgaccggcgaccccgcagccgcccccgaccagctgcgtgacgcgctcgccgcgatcgctgctgaggcgcaaaccctcgggctgacgatgagcacccggcacgagcccgctcccgcgccgcccgcggcggcactgccgcgcagcgtgcatcgcccggacggattcctgcgcgccaacgacgacggcaccttcagccggctcgacgacggccagtgggagtcctacaccgtccccaaggcccacgccgctgaactacgcgcgctgctgcaactgcgcgacaccgccgtcgcgctgctggaagcagaagcggccagcctcgacaactccgccgacatcgaccagctgcgcaccgagctggatcgccgctaccacgcgtacaccggccggtacgaggcgatcaaccggttcaccgacgtgccggcgctgcgcaaggacaaagccaccgacaagatggtcccggccgtcgacgaagagaccggcgagccgatcatgcgccgccagcggccgcccgccgtgagccggttccgcgccgacccgttcgcgccggtcgtgctcgccctggaaatcttcgacgccgagacgcagaccgcaaccaaggccgacatcttcacccagcgcgtcgtcgcccgccgcgcgccgcggctgggcgccgacaccccggccgaagcgctggcgatctgcctcgacgagcacggcgaggtccgcctcgacgtcatcggctggctgctcggcgtcaccccggagcaggcccgcaccgcgcttggcaccctggtcttcgacgacccggctgctcgacgcctggaactggccgccgcgtacctgtccggcgacgtgaagaccaaactcgcgatcgccgcggccgcggccgacgaggacccgatctacctggtcaacgtcaccgcgctgaccgaggccgttccccgcgatctgagcccggatgagatcaccatcaagatggacgcgccgtggatcggcgcctcctacatccagcagttcctcaccgagatcctcgacgaccccaccgtcaaagtcgaatacggcggcggggtcatgtggtcggtcacctcgagccgcaccgacacggtggctgcccgctcaacctggggcaccgagcgccggccggccaccgagatcgcccagaacatcctggaacaacgcgacatcgtcatcaaggacaccatcaagcgcgacggcgacaaacggcaggtcgtcaacctcgacgcaaccatggaggcgatcgacaaagccgtcgagatccgcgaacgcttcgccgactgggtgtgggaggatccggagcgcgccgcgacgctggtcgccagatacaacgacctgttccgccggtacgtgccgcgggactactcgggcaccgagatgtcgctgcccggcctggcgaccgcgttcctgccggacccgcaccagaagaccgcggtcgcccggatcctccacgaaccgggcgtcgggctctaccacagtgtcggcgccggcaagaccgccagcatgatcatgggcgcgatggagctgcgccggctcggcatggcccgcaaaccggcgatcatcgtccctaatcagctgatcgaccagtgggtccgcgagttcgtccggctctacccccaggccaagatcctggccgcgggcgctgaggaactgacaggcaccaccgccgacaagaccgccgacatccgccggcgcaccgtggcacgcatggcgaccggcgactgggacgcggtcatcctcaccgagacggcgttcgagatgctgccaatgagcatcgaagccgaacacgcctacctcgaaaacgagcttgccgcgctcaaggaacgcgttgccgaggcgaaagcccacggcaacgagaccatcctcaaacggcttgagacgaaactcgccaaccgcgaagaacgtctcaagaatcggctcgacaatgccaaggacgccggcgtctggtgggaactgaccggcatcgactacctgttccgcgacgagagccaccgcgacaagaacctgcgcaccgtctccaacgtgccgggcatgacgatccccggctcgcagcgcgccacccagatggacatgaaactggcctggctgcgcgaccggcagccgcgctggggtacccgggccaccggcacgccgatcgccaactcgatcgttgagctctacaccgaattccgctacctgcgccccgacctgatggccgcactgggtgtcaccgacatcgacagtttcctggccaccttcgccgaaggcgaagccatcatcgaggtaaccccggacggcggaggcctgcgcaacaagatccggcacaagttcgtcaacctcgacgagctgatcacctccacccgggtcttcgccgacgtcaagaccaaggaccagctcgacctggaacggcccgcgctggccgaacgcgccgacggccagcgcacccccgagatggtcatcgtggagcccagcgccgagctgctcgacaaggtcgccgagctggtccagcgcgccgccgacctgaaaggccgcggccggccggaaaaaggcgaagacaacatcctcaagatcgtcggggagggtgcggcggctgccctcgacctggccctggtcggcctggacaccgacgaaccgcagaaactcgacgtcgccgccgaccacatcgcgcagatctaccacgacaacgccgaccgggtctacggcggcccggacggccagccgcacccggtcccgggtgccctgcagatggtgttctgcgacctgggcacccccagcggcaagcccggcaagttcaacgcctacgccaaactgcgccgcctgctcgccgaccagggcgtgccgatcgacaaggtccgcttcatccacgacgcgaccaacgaccgggaacgcgccgaactgttcgccgcctgccgtgacgggcgcgtcgccgtgctaatcggctcgaccgagaagatgggcaccggcgtcaacgtccagcaacggctcctggccctgcaccacctggactgcccgtggcggccctgcgacctcgagcagcgcgaaggccgcatcgaccggcgcggcaaccagaaccccgagatccggatcctgcggtactccgtggaacgatccctggacgcgttccgctggcagaaggtcgcctacaaagcacgtctggccgaccaggtgctgctcggccaggccggccgcgaagccgacgacatcggcgacaccaccctgtcgtacgaggagatgaaggccgccaccaccggcaacccgctgctgatcgagcacgctgaagcgcaacgcgacttcggccgcctcgaacggctgcagcgcggctaccaccgcaaccgctcacagctggaatggaccgtccgcagcaaccggcagacgatcaccatcaacgagcaactggtcgccgaggccaccgccgcgatcagccggcgacagcccgccaccggggatcagttctcgatgacggtccgcggccgccgccacggcaagcgccgcgacgccaacgaccacctcaaaggcgtgctcggcctcgcggtcaatgacccggcttaccgcgataccgacaccaccatcggcgagtacggcggactcagcctgaccgcccgcaccgccgaggtctgggtcaagaccggcaacagcgtcgaccgaggcatagaggtcgtgctctccctcgccgacgtcccgcaatccgaggtgtcgctgctacccaccgaccttgcgaaagcggacctggtgacccggctggagaaccggcttaccaacctcgacaccctcatcaccaagaccaccaccgataccgagcgctgccaccagcagatcgaacgcgccgaacaagaactcaccaaaccgttccggcacgctgacgctcacgccgaggcccgccaccgattccacaccctcgacgcccaagtccgggcgctggccgccgcaagcgaccaggaaaccggcgtgggcgaacccgaaagccccaccaccgtctcgacgcccgagcccgcagaagcagcacccgaaccgcatgctgcccggcctgcagccatccccgcccgcaacgccccgtccgccggtcccgggccagcgacaccggcagccaccagcgcgcccacgcccgactcgctgccggccacgcacgacagcgacaccccgccagacctgctggagatcctggctgcacttcccgtcaaccaggagcaatggctgatccgaagtgtcacccggctcgccggcgatgaccagatccgcgcactcgcccacgccaactcatacgaccgtatcgccaacatcctgcacgagcgactcgacgagatggtcgccgccggcgccgttgacgacgatccgtctctagccgacggcatgtccttgctgaccagatacttcgacgacgacacgctgcgcggtccgttcctcgcggccgccggcccccacctctacgcccagggccgcgccgcggcacccaccgatcccacgctgtccgacccggcaccatcgacgtcggccggggcacaacctggaggagtcgtcggcgccgcagcacgcctagaccagctactgaccgcacgcgagatcacccagcgtcagcgtcaatggttgatcagccaggtcgaagcactggcgcgggaaccgcggacagtcgcagcagtccatgccaacgactacgacaacttccacctcgcggtgaaggaaccgattgccgacctcctctcgctcgtcgccggcgacgagctcagcgacgacggattcgacctccacagtaagctcaccggccgccccggaccgctggccgacgcgttcatcagcaccgtcagcgaatacctgtacgaagccgctggatccgctgacatgctgacagcgccgagcactgaccctgcaccggcgccgggcctaggccggggccagcagaagccagcgtcaaccaccgcgaaggtcgacggcgaggtgctggcacaggccgaacagtatggtcgcgaggcgtacgcgcatgcggataccgccgcacccgctgccgacccgcgcacgctggccctggtggcggactggccggttggtgccggcgccgaccaggtattcgccgcgttcagccgcggctacgctgcggccgccgaccaggccgccgcagcagttttgggtgacggcggacctgttgtggaagcggtcgcgggcccggccgtgtccgagtcgactatgtcgcttgccgcgccgtcggtctccaccgacgctcccgcatcgggtgacgacgagcagttgctgcgtccaccggcagcgcggacaccgcaggtgtgggagttcaccagcaccggcgtggcctacgacgctgtcaacagctcagacgacatcgtctccggcgacatcctgcacgtaccacacgaacacatcgttgcgatcgcctctgcggcgtggcctgtcgcggtcaccgccgagcccggcgccttccaccccgcagaccttgctggccttgccgcaatcgggtacgccgacagcatccggctcgcccagaacctggccaccgcccacggatatgccctcgacggcgagccagcacaacacgccgaagccgcgacctccgacgctgcctcgaccgcggtgggcgccggggggctcgaggacagcccgcaagccggcaacccgcaggcggccgaacctgatccggaccgcgtttccgcaccggccgaaccggttggccccaatccggcgtctccagccgggggagtgctcccggacggggcggaaccgatcgacgaagtttctggctatcacgagcacgacctgaacgggcagatcaccatctacgggccggaccacagtgtggtcgccaccgcggaccccggtgctcgcatcggcctggtcggcggcgtgcggatccccgcagaccgggccggacggtaccgattcggggtcctggccgcacgtcagcaccgcgctcagcaactgccgcgggacagccaggaccgagtgtggattcagctcgttcccgaccgcacggcgaaggccggctacatcgtcgaggtgcacgggaccgtccaaggtgatgccgccgatgaccgcgccgtgcgtgaccgggccgccttgaactggtccggcaagaagaaggctcgggtcaccagccgtacctggaaccccgcgacggtgcgcaacaaactgtatgaactgctgaccgaattcacccggcagaaccgcaacgtcgtcgtgcgcgacagcgacccacggcccagcacgcccctttcggaaccagctcagaaccccaccgagcagcgcatcgagcgggacacggcgaccgcagcagagcccgcgatgggcccagccgctgaagccgaacccgcagccggaaccgaccatgagcccggcctaaggccgccgtccgacggtcagcaacacacgacgggatccggcgggcccgaccgggcaccggatgcgcctgaagcgttgcccacggcctccaacatcgctggtcagcccgccgggaaccaaactccaggtcaagctggccacgagcttgagggccgtgctgctctgcccatgccgaccccggatacgaccgcgcctccctcagccgctgccgtacccaccgcggccgacaccatgcccctacccgccggcgatcagacgctgttgacgcctgcagcacctgctgccgaccaatccaccgccaccgaacccccgccgggagctgggcccgggacgcctgtcgcagcggcgacaccaccacctgcgggcgacaccgaacgcgacgccgacacggcggcggccgggccggacgtcgaccggtcgaagccgcagccgccccagaccgcaccaccgatcccggcggccgccggcgacccgaaccttcacacggaggcgacgacgatgccagagccccgcgctgcgggcacccacgcgtgggaccacatcacggtgattaccgacgatggttttgcccgcgtcaccggaacgaccggcagccccgccgaagcacccctacgtgattttctgaaagaccccgcgaactttccgggccggctgcgtttcaccctgcggcgcgacaagagcgagtgggtgctgcgcggcaccaccgcccaggctagcgaggccgcccgcaccgtacggcgctggctggctgatcccctgacgaggctgagcggcaccaccaccaaggctgatctgcgcgctaccccggccccgcccgcgccaaagacaccaaagatcactctcagcgagcagcaacaggcgatccggcaggcgtacctggacggcaagaacatcgccgtgcaagcgctcgccggcaccggcaaaacgtcgacgctggtcgcgcttgccgaggcaacacccggcaagaggatcgcctacttcgcgttcaaccgggcgatcgccgacgaggcgaaggccaagttcaatcccacggtgcaggccgagaccagccactacttcgcccggaccgggctacgcacccacgcgatcgcaccgaagctcacccgggtcgtcgatggcgacggctggccgagcgagtgggcaacgccactgcagatcaaggacctgatcctgcacgacagcgagcactccgaactggtgagcaaggagcggatcgccggcgcggtgatggccacgatcaacgcgttccggcagagcgctgacccggagctgtccaccgcacacctgcccgagcaccttgcccacggcaacaaacggctgcgcgacgtcgtattccggcatgccgtccgtgcctgggtcgacaagacgagcgtcacgggcacgctgccgttctgccacgacgactaccgcaagatctgggccctgactaacccgatcctcacctacgacgtgatcttcttcgacgaggcacaggacatgcagccggtcatggagaaggtcatcctcgaccggcagaacgccgggaaacaggtggtcatcgtcggtgactcccagcagtcgatctacggattcaccggggccagcgacgcgatcagccgatggccagccgacgtagtgcttcccctgacccagtcctggcgcttcggcgccgcagtcgccgaagtcggcaaccggctcctgaccagcctcgaatcacggtggcagctgcagggcaacccgaacctcaacagctccatcgggcccgttccctacccggacgccgtcttggcccgcaccaacgccggcgccgtcgccgccgtcttcgacgccctcgaccagcagcgcaaggtggcactggtcggcggcagcaaagtcatcgagaacattgccaaggccgcactcaaactccaggccggccgccgcaccagccaccccgacctggccgggttcaccacctggtccgacgtggtcgacgccgtcgagaaccaggagaacggcgtccacccactgcgggcgttcgtgcgcctggtcgaatcccgcggcgcccagaagctactcgacatggcccgcgacctggtgccggacacggcgaccaccccagacggcaaacccgcctacgacgtgatcgtgtgcaccgcccacaaggccaaaggcctggaatgggacttcgtccggatcgcctccgacttcccccaaccggaactggatgaagccaccggcgagacccggctcccgggggcagaagaccagcgcctggcctacgtggcactgacccgaggccgcacccgcacccaactcggctccctggactacgtgaccagttccgcgctggacagaccagcgaccagccacgccgccatcgccggcccccagcagcaagctctcaagcccggaccggatctggccgacacgtccacccgggtcgaaccacgtgctgccgagccgctaccgccggtcgccgtagccgccggcgagccggagcagccggataccgacgccgccagtgccaccgccgagcctgctatcacgggcaatcccgatgtcacagcgcagttggttcccgccgacatgcctgccaccgacccggtcgccgcagccgcgggggagcggcagccgacgctattcgagaccgtcatgccgccagcggcgaccacgtcgaacaccgcagcccagcagccgccaccgcacccggcagcagcggcgacaccggacgccgaccaggctgccctgaccaccgccgaccagctcccacagaatgccgaggagaccatgaccgccgacatcccggacgccgagcacccgagggccaccccaccagcggcggcaaccgacccggatccggtccacccggctgctcccgacgacggcgcaccgatcaccccgcccgtcagccagccggagccggaggagtcgccgaccctctcagggcccgccacggcgccgagcgccgatgccccgatcatcgcggccccggccccggatgctgacagcacggccggaccgcagccgacctcggcgggcaccaccgggccggacgtgtggcagcaggcccgcacgatcctggccgggcacgagcaggagccggaggcccggcttgcgtgggcgctggcggccaccgcagtccagtccggcctcgccgccggcacctggtcgatgacgcccgacgcaaccgtcggagtgacgggcgtcgtcaacggccacgtcaacgaccagctgcgggtgcgggcggacaccggcgcagcccgcctcgagcgccacgacggcaccatcgtgtacgccgctgactggcagcggatgatgcggatcctcaccccgcagcaaacgagcaggctggccgcggtgagtaccgccgccgctgatgccaagcagcgcctgtccggcttcgtcacccggtcccggcagaaactcaccgagcagcggcagaagctcgtaacccggtgggagaacctgcgcgacaaggccctggcgaccgccgcagacatctgggcgcacgtcagaaacgtccggcccgcgatgcagagcacaatcaaccggctggcgcggaccgtgctcgccgccaccgaaccgccccctgccgcggcccgagaccagcagaaggcggagcaggctggccccgacccggtcggcactgcgcagccctctacatccgcgaaccgcagcgacgacaaggcggcagacgacaaggcggcatcagcgccgagcccggaagccgccatcgcggcgcctgccacccacgccgaagaccaggttgacgcgaacactccggcggtgatgcagccggccgacctcacccacatccgcctcgtggtcatcgacacggccgccgagtacttcgccggatcacagggccacggcatcgccggcaccgccgtgcacctcgcccaaaccgcactgcaggccgaaaccgcccggttcggcctggccccggtggtccaagccgccgcggacgtcatggccgacgaccgcagcatcctgacccgcacccccgaacagcggcagacggcacgggcgcagcgcaccgcccagtccgagatgttcgccgacttgatccgttccctggccgccgccggtgacaacgaggcagcgctgcggctgatcgacgacgccgcacgccacgacccgcgccaccgcaccacctgggcccaggaacccaacctcagctggagcgaggtcagcgaccgtgtccgcagcacccgcccggccggcacggcgttcgtcccgatgccccgcgcagcgtcggcgggacgcccggcgccagccggcgccgggcaggccttcaccgccgccggaacccggagcaccccggcaccggcgatccgccgcccggtcccgccgcagccggccagcaccggccaccgcccccaccgctgaacgatccgaactccggctctgcccaccccaccacccgttttaaggagaccgtcatgaccagcaccctcgccgaggtccgcatgagcgacgcggtccgccgcctgctcggcccggacctgaccgcgcgcgttgccgccaccccgctggccggcggccgctgccaggactgccacctgccgttgccgcagcacagcgtcgtcaacgtcgtggtcttccaggaccaggacagctgcgtggtcggctgcctgcacccggactgcggcacctcccagatcaggctgctgcccgccggagcgctcgctcgcaccggcccggcctcggtgccgatgcggctggtcgccggggtgatgccgcacggcggccggccgctgccggtgctcaccctccaaccgatcatgcaggttgtggatgtcgcccggccggtggccgtcgatgcgttcctcgacgtcctggtgcaggccgggatgaccaccgagctcgactttctccgggcgcctgagccgctgctgggctggccggtggcgatcagccaggccagtgccggccaggcagccatccaaatccggatgcccggcggcgcgctgctggtcgacggggtcaccgcggtgtcaccggcgtggcgcgacgccgccagccggtacgggtggtgcgtgctgtacgccggccggaacctcggggacattccggccgggcagccgcacaacgggtcgcttccccaggccgggctggtggctggggcccggctgcgactgttcggcgccagccgcaacctcggatgagcccccatcaccaccctgcgacgccaccagagctcgccgtgccggcccgcaacgacatccgggtggcggccctgctgacctctcaagccggtcggcaggtaccgactgtggccatcgaacaccagccgccgaccaccaccgcacccaccagccgcagccagcacggcagcacactgctatccaccctcgtcgcctacggcatgaccaccgaggtgaacctccatcagacggcccggccactgctgaactggccggtcagcatcgggccgtccggcccgatgcgcgctcgcatccggatcgttctgcccggaaacctagcgccgatcgacggtgtaaccgcctacaccccactctggcgaacggcggctacccgcacggggtggctgctgctctacgccggataccaactgtgggaccccaccgaggccgcacctacctcggcatcgatcgccgctgcctggcgggccggaacgctagcggccgccaggctgcagattcgccgacctcgatgctgaccactcaatgcctgccttgcccgtcaccatcagtaagcgcgaggaggacggtggcatcatctgccagttcgctcttctgccgagaagagtgcactgcatgagtaaggcgtggccttttcgatgtgatcgagcgccgcattctagtggagttctcgacggaaccacgtcacgcgaaggaatatcagtcttactagtgagtagcggatcacaagcggcaaagtagccgatggcccaagacgccattcggatgacgggacgccagacgttcttcgtctagttgagatctcccgtaggctcgcgcccgatgtccaatatcaagcttcggagatcaacgatgaaattgttctcatctgcagttgccgtcgtgacggttctggcctcgacagtcacgctttcgccgacggccgcgtcggcggcaacctctacccggcttgcgaatgtgggtagtggagaggctcagtgtatggatgtcggctcatatgccgtcggcaccaaactgatcctgtttccatgcggaagccaagtcagccagcgctggagcggcttcaatgcccaagacggaaaggtggtcagcgccggaagcggaggtgcacagtgcttggacgtctcttcctatgcgaagtttacgccggtaatcttggcgccgtgtggctcggttgccagtcaacagtggaacattggccctaaccggcaaattcgtagtactggaagtggaaacattcagtgcatggacgttacatcttatgcttcgagtagtccggtgcaactctacccttgctccgctacgcggagtcaacgttgggccttcagctgatacgtctgaggcgacgtgcggtcggcccagcagtctgacccaaacggccgacgcgggccggactgctgagccagtccggcaaacctttatagtctcgcgccgctatctgatggcgtgaattgtaacgcgctttcgcattatcacgagaggtcaacagacggcatcgagggatccgacgcggccaagtatgtcccgaacggctggcttctgctgacgtactgtcatgccgcgagtcgcgcgtcacgaccgtcgccacccgccattcgcggtgatgggtgcttcggggcacggccgacgcccgcttttgccgaaatccgtataatggatcgcgtgcgcctacctcggtgggccgtcggccgggcccgtgttgccagacccccaccccagccaagtcattaccggcggaaaacctgctcggacacgcggaacgtggtgccgcactgggtgcaggtggcacggccgaacaggtatgtaagggcagcggcgacggattgctgcccggccgccaggctcatcagatgcaaccgttgaccgacgccggtcaactcggccggttcggctggcagcaacggcgtctgctcgacgtccggctttgtcgcgtagtcctcgtgggtggcgaagcagccgtctttcccgaacgccacaaacagcgacgttgtgcactgcgggcactcgacttcgacctcatcgttcccgatccgatcgagctccgcgccccagacttcatcgccctccagcgccagcaccgcctgcagacgatagacgaacgagcccggatcgatcggtgtgacaagccagtcgtccgccagccggtgcatggtcgcgaacgcttcggcataccgcggccagttagcctcatcaagatccgcggcaatcctgcccgcaagcatcagaacgttatcgcggtccgccggtgcgtaccggcctgcgagatcggccagacgcggaatgagaaaggcttcgtccgcatccaagaatctctcctgccccgccttctcgtgcaacgagtcccaagcatccgcgtacggatcggccgcagcagccgccagcaacccctcgacctctatcacggcatgaatccaaccatgacgcgggatcgtgccggcggcgctcgaggcgaagatccaaccccgtggcggaacgacatgattggtgcgctcatctgccgctgataaggcacgtttggtccggtcgccgccgtaccgtcagcaacgcaataggtgctccgtcggagtgcctgggccgggtcggaggtaccgacaagctcaggtcggctccagttagggcagggacttggtcatccggatgcccgggatcaggccgtgctgttcccagctggtgacggtgtatcccgcgctgcggtacaagtcgatggcgggatgctggtcggggccggtcaggagcacggcccggcggtagccgagtctgacggcgtgatcctccagtgcgtgcagcatgctgcgaccgtagccacgcccttgcacgggagccgcgacccgcatccgggtgatctcgcaggagtcgcggtcgacctcctgcagcgcccccatcgcgactacgcggccgtcggcttcccccactagcaggatggcccggccccggaggtatgtcgccgccgggtcgtcgaggtcaccggcgtacacgtcggcgtcagcaggtaccccggcggcggccaggccggcccggttgagttcgtggaccaccaggaggtcggccggctggtagacacggatccgcagcggcggcacgtcggtcatgggggagcaggctatcggccggcgatgaccgcgtgcaggtcccgggcggctgtcaccgtccgccgctgggccggaacggatgcgaccaccgtggcggcccggcgcaagatgatcgccgggcgatagtcggcgggcaagtccagcagcacggtctgcgcgtgcgtgacgccaccgccgatgtcaccggcgacgaccatgcaccgggcccgatccagctgcaccaaggccgggtcaagcatctctcccgggccgaacgcggcgagcgcctggtcctgggcctgcatcgcggcccgggtgtcgcccaggttggtgtaggcgtcggaggcgtaaaagtgcagctggccgagagtgaacgtgttcgcggtgttccccatctcgggcccgtccgggcaggcaggaaacgtgtgctgcgcctgctggagagcatgacgggcggtatccgcgtcgccagtgacggcggcggtgcgggccatgatggcccacgccatggcggacagccgggacgggtggcggcgggtcagcatctccgcttcggcggccacggtcgtcgcggtgaccggatctcccagatgcagcgcggtcaccgcggcccgggtcgcgacccatgcccgcagcaccggctgagcggtctcgtcggccgcgaggcgggcggtgtgcaaccactgccgggcctgccggtagcggccctggtttaccgccaccatcgacaccagcccggccaacttcgcgatcaccacacacaggtcccggcgctgcccggtcggtagtttccggtcggcgagccgccacgcctcctccaggtcggcgaacaagtcggcgaggaaaaccggccgatggttgtcggttttgtagagccggccgtgctggtcggcgacctgcagcaggtggtcgatggtggcatcgctgacggtcgtggccgacagcgtggcatcgacattgcggcgcaactcatcggccgcggcaagcacgtcggcattgtcggccgtaggcccggccggcgtcagtgacgttgcggcaatcggccggatgtcgcagtcgatccccgccagatcggtgtcatagatcgtgaacagcgcctgcagcgaagcagggctcgggcgctccttgccggtttcccaccgcgaaaccgtggtcgccgccagccgactgccggcgccgaggacctgccgcaacctgccgaccaggtcactgctggtccagccgcgcgccagccgctgggcccgcagcctgctgtgcccgcaccgctggatgatcgtgtcgaccagcgcggtcagcggccacccgtcggtggtggcctgcgcccgcagcgccgcggtgcaccggcaccggggcgagtgcggcatcgacatctgcccggtcaatgtgttcacgactccacccaaccacgccgtcacactcgcagccgaccgtgaatcacccgcacggtgccggctgaaattgcggtatccgcacgttccgccgccgccacgcccgcacggacgacaacatgcgcgcaccgtgcgcgggcaccgattgccgcctgctgcgagatgcgggattctgcctggcagatcccgccgatcacgagtcctctccccgtgaggcctcacgtcggcgggaaccatctcgcacagtccgcccagccgccgtggccctggccccgccagccgcccgcggcccgaccccggagcgaatccgcgatgcatcccagcctgccgcctcccgcagaccgcgccgtcacgccggccgccgcgagccgcacgctgccccctgcccggttcgcccaggccatcctgctcaaccccggaccggccatccgcgccctcaaccgcagcacactgccggcaggccagcggctggccctgctggccgaggcccttttgaggctgggccggaccgagccggccatcaccgccgcgatccaagccgtcacggttgtcggcgcccaacgcccgatgccggccactgacctgctcgccgcgagcacggtctgcaccgacattgccgtctgggtcggtgacctcggcgccgcccgagcctgcaccaccctcgaacagctggcgctcgactgggacgaccatccgcgccggttcctggcggtcgccctgcgggccgtcgcgctgtaccagcacacgtcctgccggaccgggctagcgttgctggaccggctgaccggcttctaccaagcccgtaacagcagcgaccccatcggccagacgctcactagcaccgtccgcctgatgactgacatctgcgccagctcgcaccgcccgcccgcgcctttgcgtgccgacccggtacccggcggcctgctgcaccccgacatcacgcacccgaatgccggctacctgcaatcgcggctgctgcgccacccgggccggcacacctgccaatgacattcctcaacccgggcgctcactgtgacgacaagatcaggcggcggcggggcgagccggtgtgtctgcctggctggctgatcaccgtccggccgcggatccaacccgatcaccgctggcggtctgttcgagggtgatgtcagctgggcgcagatccatccggaccctgatcaggcgcgccccgtgtcgggctcggccgaacggcccgtcgatggccgtgtcgacctcgacctcgacaacggctgtcggttccaccggcgtgtaggttaacggccgccggtcgttgaaccgggcggtccatgccgttggcaacggtattggccacggatgcccggcctgcgggccgcggaataccagagcgtgcaggaccgcggcgaggtcagcgcgatgctcgggccggaccggatgcgtttggccggtataccgcagcgtccccgtccggtcgtaacgcccgagaagaagggtcaccggatgatccacggtcccggtcaccccacccaccacgtattcggcggtgtcccgagtgcggaccttcgtccacgaccgggtgccgggacggtaccgttcatcaatcttcttgatgacgacgccttcaattccggcggtaccgaggtcctgcatccagccgcgtgccaccgccggcaccgcagtctggggacacaacaccagctgcggcggggcggtccgcagcatccgctccagcttcgcccggcgcaccgacagcggctgatccagcagctcggtgccgcgcccgtcgcgcagaaggtcaaaggcgaccaggtgagcgggatgtttgcgggatacctcagcgatccgccggccggccacgaggcggcgttggagcaacccgaagctgcaccggccgcgatcgggatcccagaccaggagctcgccgtcgaggacagccctcggcggtaatgctgcggtcagcggaccaacaagatcaggaaagtacgcagtgaggtctgtgccgtggcgcgactggacgcgcacaccatcagcgtttcgccagatgatggtccggaaaccatcccacttcatttcgtagatcacaggggtggcgcccggttcgggaagtgcccgcagtgacgcagtgccgacagggacgaccggccagtgcagcacgagggccccctctgtccgcgggaaacctcacgctagccccggccatgcaccgttcacctgggaaaacgcaaaatcagatgacggccgcggccgcgggaaggtgaccggccgccctcgggtcctgtggcgcacggtgatggctgcggccgaaggaggcgggagcctgcaccgtgattctgacgggtaacggtgggttctggcacacgaagtgtgactgatcttggttttggggggtgaagcctcggtactccggcgtggcgcaggcatgggcggtatcgcgttgatgccgccgacgcggtggcgggggttattggtttggcaccgtcagcgcagatcgttaccttgcccgccatgacccttcgtattgagcaaccgcatcactatgacccggtaggtgctgtccatcgaagtgccttcggtggacagcacggcagcacggtggccgagcttgtggacgcgttgcggcgcgatgatccggcagcactctcactggtgtctgagcaggcgggcgaggtcgtggggcacatcatgttcagcagggcgctgctggacgcaccacggcagctcgtggcggttcagtctctgagcccgctcacggtcgcgccgcagtggcaacgccgaggaatcggttctgagctcatccgcggtggtctgcaacgactcgacgagggcggtatcccgttggtgttcctggagggagatcccggctactactcccgtctggggttcagccccgcagtggagcagggcttccgtaagccctcgttgcggattcccgatgaggcgttccaggtcgtaaagctgtcggcctacgagccctggatggtcgggacgttcgtctactcgaacatcttttgggagcatgactgcgtcggcctgcgtgaggcaacgcatagcgatatgggcgtcttgtcaggcactgagtaggactcgtttgcggagcaggtcgaatccagcgcggccgtacatctgtcgtttgatcatcttgattcggttgacgttgccctcgacgggaccggagctgtggggcaaggtcaggccgccgtgacggcgtcgaggtcgttggtcaggccggtagcgaatcccgtgaggccgggcagtgctgcctgctgagcggcggtaatccagacgctgagctggtttccgcgcaggttagtcagcatgccggcgaacgagcgcacgaggtcggcagcggtggccagttccgggcagcggtcaagaagggctcggagccggtcgctgtcccgctcgacaaggtgatcgggatggcggcagatccagccggttacttcgcggaccgacgggagtttgaccatcacgctcagatccgggcgggcgcggtgctgttcgacgaaggcgcggacgatgccgtagccgccgttgaagccctgtgcggtgatctcgcggtgcaggactgtggctttggaacagccttcgctgatgcgccggaggagatgagccttgaacgggtcgaggctgctcgggcgtggtttctgcccgacgatcatctcttaccaggtagcggcacgggcgtagcgctgcacggtgtgccggccccagccgaggtgccgggcgatctgccgaattccggcaccctcggcgagcaggccatgaacgagctggtggtgttcacggcggcgctgtgccatcgccccgcggggttccggtacctcagctgcagcggcccgatcaccgcccggtgtggtgactggttcccgcaggcagtccttgtgtcgggcgacgcaccgctcgacgaccttggcgaggttctgccacagatggaaccggtccgcgacctgcacggcgtccggtgcaccggtgcgggctccttcgacgtaggcgctggcccggtgcccggcagatgacctgcggctttgcgtgttcggtgagccactgggcgagcggggcggcgtcacggccaggcagcaggtcaacgacccgcccgtcctcgcaatcaatcaggacggtgccgtagttctgacctcgcctgatggcgaaatcatcgacgcccagcaccgtcaccggcgactccggtagatccggcagtgcccgcaccagccgtaccagggtgctgcggctggtcaccatccccatgtccgcggcaagccgagacccggcccggccggcgagagccagaccgatccgcgtgaacgtcttccgcaaaccatgggtgctccgcaaccggcggcgggtcaacccatcgacttgctcagcgaacgtccgcaccgcgcagccggcgtttccgcagacgaaccggcggacccgcagccagatccggacggctgtcccggcgaccggaacatcggccagttcccgccagtaacgcccgtgcaccctcttcgttgccgagccgctggacaggcaggtcgccgaggaggctcggacgctggcccacagccgcacaccgacatccaaccgctcaaccctttcgatcttaagggggctgagatgcggcagaagctgctggaccgtcgcgtcacacaggagcgcaacgagccatcaacgatggccgatcacacttcctgtgccagaacccaccgcaggccgccagaatcatgcaccgcggtcgcggtgatccctgccgacccgggttgtcagcaagcagtatcaggcttgtgtggtgcggcgctggcgtttgcggtgaatgccgacgacgagatacgcgcaggcaaagacgatgagcgcgtcgtgaacccaacgcagggccgcgccgccggccgtggccgggtcaccgacgaccagcgcgtacccgccgagcgccgcggccggtaccaagctcagggccatcatcacgccggccagcagcaccgaccggttcacggcgatcagcagggcaccggtgaggccgacagccaccgtggcgacagcttccgtccgggtgatgccgccccaatagtgcagcagaaaccggcaggcaggaagcgctccccgccggcgatcgcgtcgacaccgatcagccgcagcaccagcccggtgaccatggcgcgcgggcttcctagcggcggccgtgcctaccgactcgcccgcgcgccgggacgaactggtgtcgctcaggccttcttctgccggccgacagggatggcgaacccctgctcacgaagctggttagcccagttgccgatcgtgccgatcgacttgccgtactcctcagcgagcgccttgaacgagcccagggtattaaggtcggtgaggaactgctcaccgctcggccgctcactccggcgtcccgacgccgtgcggacaaccggtgctgacgtcgcagcggccgaagccttgccggtcttgccggcacgccgaccggtggacttcgccgcccgagtgcgcgccggccgggcagccgacaccggttcgtctaccggacccgaacccggctcggcggcgacctgaggctccgcctcagctccccgctccccagcggccgctaccggtgccagggtctggtggcctggcaaagtccccggatactgcgtaggcgttcccgcaacaacatcctcagaggcgatattcgacggcatgccagcgcccggattgtccgcggacacgggaccgccattggtgtccgcaagcgccgctgacaaccacaccaagacacgctgttgagcactcgcgtcgagcggagacaacaactcgaacgcagtctgcatcgcctgaagttcttgcaaagccatgtcttctccaccttcaacgtcgcgaccgcgacagtcgcgtcgtgactgcgcatccgatgagcgggtgaaacgctagatcgcccaaacgcgatcatgcctcaaattaatgatcacacatgccatcgagtgcgagtctgcccgggcctaccaacgcatacgccaccaacccccgtcacccgctcggtcgttggcacctctgccggtaacactgagggtggtcaaggcgaacacggcgtaggagttgctgatcaggcccagctcccggaacgccgcccacgccaagagtcgtgatcagtaggaggcgcccgggcgttccggcggcgaacggaagtcgcgggaggtgaaggccgctgttagagcctctccatccgctcggcaagatcaagaaggtccgtttcgcatcacgcctactgacttggctcgcccagaacggcgggctcaccgtccgccagcgcaagcagctgcggagcctgttccgggttgcgggctttgaggaagtggaatcggcaggcgcgctatggctccaggacggtcccgcaatagcgcctgaactactgaaggccttgccgaagtacctggccgacgacctgtacgcgccccaggcgctgcgcgtcctcgcactgatggggccgcatgcgcggccgatacttccctacctggatcggttcttggcctcgcggcagcgggtggacctcaccctcggcgacctcgacgccgatatgcgtgcggacgacatgctgctcgccgctatgagcgccacccgcgagcagatcaccaggtgaatcgggtcgtctgggactcacaggctgccactgcacgtcaacgaagcccatggcgcgatctgagcccgggagctcaggcccgccatgggccggcgaggaacaccacgcggtcctcgccttgccgccgaagcaggcaccacctggtccagctacgcccctggccgcggccgtgaccagtaggtgcaccacatcggggagttggccactcgcacgagggttgagcgctatgccagctgcgagggatagccgatataagacaagtcggcgatgagagcggctgtcgatcggtcagcgttcaggcgccgcaccaggctcgtggtcagcggggacaacgcgaggatctcgcggacggcatcaagatctacggccttgccgtagtagtcctcggcgaagcggtggtaggccaggccggtcggatcgagcagcacggaaaacagccgttcggcgccgtcaggatcgggacggtcgggaaagtcgatgtcgccggcatgccaacggtcgtcgtccgtttgccgccacagacagaccgtcgcttccagcgtgccttcgtaactgaacgccggttcgttcaccgcggcagagaagacgtccggcaccgtgtcgaccagtcccggccacaactcctcattgttcacggccgggctcatcgaagattcatgatcgaatccccaaagaaaggcgcctgcaggggagaacacgatcgaccaggcgtccccggagccgttgtccatagacgctagctcctcgccctccgaccaggccgacgtgaacgagtagtaccgagactcctcttccgggctcaggatcgcctcaagcaccgccaacgcgcgacagcgctcccgcagagtcgcgatatccggcaggcttccagcaacatcatgagcggtcactgccacattcaaccccacgcgcccggccgtccggcctgtccccaggcactacggaaagtgatggagaggacgggattggtaggcgaacccgtgacagttgaacacgcggtctcaccagtagggcggcccgtactgggtcggcgacctgatgaccctggtggccgggcccgagttcgccgcagcggtgacgagcggcaggcctggatggccgccagcctccacgccttcgacagcgcccgccggctcggctggttcaccgaggacctgcctgccgcggcggccgccgccggtgtgagttcgggcaggctatcccggtgctggcgtgtccttccgcagtcgcggttctataaccgtcgggagggcgcgcaggacgcatctcaagaaggtcaacatgtcggttctgaggttggagaaccgttaggccccctacgcttaagcgcatgcgtcccgccatgcttgccttgcttgccgttgccggcattcaggccgtaatcttcggtccggtggcagcagcgggaaatccgcccgatgacgcctgcttagaaggctacgtctggcgggaggcatttgtcggcgaccacgtatgtgtgccccctgacttgcgtcgtcaggcctgggcagataacgaagcagccgcctcccgaacggtgcacattccggctacaccacttaccccagtgagcagtgatttctgccaagagccgtatgtatggcgcgatgccaggccctctgaccaggtctgcgtcacccctcagaaccgtcttcttaatcagtactacaacaaaatggctccgcagaaccgactggatctgaagattaccgtgggtcgctggtggccgcagcctgtgtgcggcgcggacaacatatgttcctccgattcgactgacgatattccgcgcttccgggtttccgcctctcagttcagcgtaggacctgtcactatccgtctgcacgagacctcaagtgggaaggtgctgtgggagcgaaccgtccagtccaccccgcgaccattcaatttaccgggcggctcgttcaccgttgacattaatagatatgactgttcttggttcggaaatgatgttcctctggatgcttatattcaggctgaagatcacggtagcggcgggctctctccagcagtgcccgtacggaccggctgcagggtcctataaagcctgtttctggccttcacggcgatgcttatagtacgtggatggcggtcagtatggcggccgtccatagaagcgcgcgcttgctgcagtccagcgacagctccgcgagggcctttcgcagggcgctcgcgatggccaccgcggagggcggctgagttcctcagccttagctgcaggatgtccaaacacccgaacggcctgcatggtcgctgcacccggcatgccatcaatccggtcgagctcggtcgcgacgtcgccgatcatcggggcgtattcgaacagccgatcaatgatggtggtgatctgctcttccaccgtcagtcctggcttgcggcaaacaatcttccagctgtggaagcgggtcgcaccggttccacatgacggctgccccggatcacgacctcatcaggatcaatcagcaaccgcgcggtggtctcagcggccgacacctggttcgaggagagcgcgaagtaggcgtactggtgcacgagcatgcgccggacactactgatggcaacacagtaagacgcacgaataaccgctaggacttgacccttcgcgctatcggaggtctacccaagcgcagggcctccttggtcgcgctggtcaaccacgtcatcccaccggcatcaggaagtccagccgcgggtcggtcgcgcccggcgtgatttccaggatctcggcgtcgacgacccggtggatgacgaacgggtcggcgtcgacccgttgttgcaactgcggtagggacgtgttgtgcgccagcaccgcgcccccgagttgtggctggatgccgcccacgagcaggaatacctgatcttccagaccttgcttgatccactgctggtggccgggcatgtgctcgccggcggcggctttgttttcggtgaaccggagcaagacgatgaacatgccgttcctttacgggttgggtcttggcggatgtgacgatgcgggcggcgggcaggatttccccgagttgcgcctcatgttgcaggagatcccggtcaccgaaggcgtcggcgagtgtcgcaaggccctgctgggaagccgggacataggccggtgtttgtacgaacctgtttcggtaccagcgatcgaacttctcttggcttcaccccactgcgtaccaagaccattcggcgccacctttggcctgcggattcttctctttggcgcgctcttggcccggagtcactggtaccgaaagaagttcgcccagtggggccaagtctggttcttcgaaacaggccggcgattgttaacgcggtagatcgcgtccagggttcgtcgccgcatgtgacgtcgccgacgacctcgggtttggggatctgtttcagatgaggtcaggcgtcgtacgtggggtagtcaatgtatccgagtgggccgcctgtgtagtaggtggacgggtcggcggtgttgagggggaggccgtcgcggtagcggcggaccagatcggggttggccaggaacgggacaccgaaggcgatgaggtcggcggcgccgtcccggatcgctgtctgggcacgggggaggtcatatccgttgttggcgatgtaggtgccggtgaacgcgtcgcgaagagcgcggtagtcgagggcgctggttttcgtcgtcatgtcaccttcgagcatgtggacataggcgaggtcgcgggtccggagctgttcgaggaagtaccggaagtgcgcctgtgggttggtatccgccatcgagttgaagctgttctcgggggtgaaccgcactcccacccggtgtgccggccacactgcacacaccgcgtcgaggatctcgttgagcaggcgcatccggttgcggggactgcctccgtacgcgtcggtgcggatgtttgtcgcatcgcgcaggaactggtcgacgaggtagccgttgcctgcatgtacttcgacgccgtcgaatccggcgtcgagcgcccgtttggcggcatgctcgaattgagcgacgatctccggcacctcgtgggcttcgagttcgcgtggcatgacgaactcctgaagccccgaaggcgtaaaagtctggcccgacggccgtagcgccgatggcgccaccggggtgctgccgtccggcagcaggctcgggtgcgagatccgcccacagtgctgcagttggacgaagacgcgacctgattctgcgtggaccgcctcggtgaggcggagccagccggccgcctgggcctcggtgtgaatgccgggggtgttggggtagccgacgccctcggccgagacgggagtggactcgctgatgatcaggcctgtggtagcacgctgacggtagtgggtgaccatcatcggcgtgacgaccccgtcatggtcggcgcgattgcgggtcagcggtgccatgaccatgcggttcgcgagggtcagatctcccagagggaacggctcgaaaaggccggttgacaaggtgacctccgctgctatctcttcactaggacgggcgtcccaggccgaaacattaggacgggcgacctaaagacgtcaagcgggagcgctcttgccgacgcgtcacgtaggacgggcgacctagccgggtgttagaatctgcgtcctgacgagggggtgtgtgatgggcggcgtcaaggcgacccgagagcagatcatcgaggcggccgatcggctgttttatcagcaggggtacgagcacacctcgttcgccgcgatcgccgaggccgtccagatatcgcgagggaacttttactaccacttcaagacgaaggacgacatcctggcggccgtgatcgatgcccgtctcgccgagaggcggcggatgctcgagcgatgggagaccgaggagcccacacctgccgggcggatccgcaggtacatcgagattccgctgaccaatcgggctgatgtccagatgtacgggtgcccggtaggcactttgaccaccgaactggcgaagttgaatcatgcgtcgttcgctgaagccaacagcgtgttcaccctgttccgcacctggttgcgtgaacagttcgcgttgctcgggcacgaatcggaggccgatgcactcgccatgcacgtcatagcgttcagtcaaggcgttgcgaccttggcgaacgccttccacgacgaagggttcatctggcgcgaggtcaagcagatgtccgactggctaaccgcctacgagtaggaccgaaccatccgcccacgcctggagcggcaggaggatttgaagatctgggcgggcgggcccgctgtacgggcaggccctggccggttgtcgccgggtgctcggtgacgacccacccgattacccgagtggtgcaggagaattggtcatcgctctgaagcggtgaacctgaggcctccccgccgccggactggcggcatggtgaaccggccggtgatccgggcagggatcaccggccgggtccacctgggtgggtggacacggtcgaccgtcagacttatcggcagggctgctgccggtctgagatgggttgcatctcgggtgcgctgctaagccgggttgtcgggtaggtcgaagaggcagcgagggtagcgggggcagccgcagcccctgaggctgaaggaccactctgatggcccgtactgatggtgtcgtgcgccgtaccgggaacccggccggccgttggttcgctgatcttccggtggcggtgaagattttcaccgcggtgggtgtcgtcgcggccgcggcggttgctgcgggcttgctggcgatcgccagtttggccgccgtgtaccgcagcggtgaggccatccagcagaagagcctggtcccggcggtgcagctggcccagttgcgtcagcaggcgttgaccgcccggatcgcggtgcgtgacgtggcgctgctggcggacaagaaggccgcgcaggccaagctggatgcggccgacaaggctgtcgccgcggcggcggccgcctaccgggccgacgcgaacgacccggccggcgtcgacgagttcacccagctgtggcagcagtacgtcaatgtgcgggacacacagcagcttccggcggcgcttgccggcgattacccgacgttcgagaaggtggccaccaccaccgccaacccgatcatgaccaaggtgatggccgcgctcgacaccgccggcgccgccgagcaggcgcagggcgtcgcgcgggtgacggaggccgctgacacctaccaccacgcccgcaccaacctgatcattctgctcagcgtgggtgtgctggtcggcgcgatcgttgccgcgtacacggtgcggtgcatcgtgcggccgctgcgcgaggtcggcacagtgctgaccgggatggccgggggtgacttgaccggtatcgccgaggtgggctcccgggatgagatcggccggatggccgccgtgctgacgcaggccaccacgggtgtgcgggagacggtgcgggcagtcgccgaaacggctgacggcgtcgcgagctcggccactcagctggcggccaccagcaccgcgatcgccgggaccgccgaggacacctccggccggtcgcagtcagtcgcggccgcggccagccaggtgtcggccagtgtgcagtcggttgtcgcgggcgccgaggagatgtccgcggcgatccgggagatcgccgagtctgcctcggatgcggcccgggtcgccgcgtcggccgttgatgcggcggccagcgcctcgggcacggtcacccggcttgatgcctccagcgccgagatcggcaacgtgctccagctgatcaccgcgatcgccgagcagaccaacctgctcgccctcaacgccaccatcgaggccgcccgcgccggcgacgccggtaagggtttcgccgtggtcgccagcgaggtcaaggacctggcccaggaaaccgcccgcgctaccgaagacatcgccgcccgcgtctcggcgatccagtccgacgcccgcgccgccgccggctcgatcggcgagatttcccgggtgatcgagcagatcaaccagtaccagaccacgatcgccgcggcggtcgaggaacagaccgccaccaccgcagagatcggccgcaacatcgctcaggcagcgatcggggccggtgacatcgccggcaccatcggcggcgtcgccgacggtgccgccagcaccagcgccgggatgaccgaggctcgcaccgcgaccgcggaactgtcccgggccgcgaccggcctgcaggacctcgtccagcgcttccactactgagatccgcccgggcgccggacaaccgacgcgctcagggccgccgcagcaacgtcgccggcagcccgtaaacaccgcacccgccacccggccgcgccccgcgattgccacagctaggagtcctgcaatgaccatccccggctacgactatgcgcaacctaccgagaaaagcctgctcaccgcgctcaccgcatccgtcggcgccgacgcggccagggctctcaccgacctcgcggtcaagaaggccggccgccgaacctcggccagcaccgacgacctggtcaagatgaccgagtacctcatggagctcggcgacctggtacgcgtcactgcccgatccgagaagatccgcgccgtcacctaccgggcgttgcacgacacggtgaagtaagcccggctcactgccagctgcaccaggccctcccgcaccatccccaggagaacaccatgtccgccgctcccgccgctcacaccctgaccgatcctgcccggatgcgtgtcctggccgcaatcgacttcgacaaccccgccctgcgcgccgggctcaaccacgttgccgaagacaccgcacaagccaccggcatgccgatcagcctggtcaccttggtcctcgacacctcacagctgttcgccggttccaccagccttgacggctgctggatcgccgcggccggcggcaccccgatcgagtggtcgttctgcgtcaacaccgtcaccaccggacagccctacgtgatccccgacatggccgcgtccacacacgccgccaacccgctggtgaccgtcgacaacgtagccagctacgccggcgtgccgatcgtcctcgccgggcagaccgtcggcgcccactgcatcatcggcgtcaccgcccagcagttcaccgccgaccagctccaacagctgcacaccggagcacaacaggccggcgctctcctgcagcagttcagcaacctcacctgagcgatatcccgccgccgatttaccggcgagacgagcacccgggcacgggctacaccgagacgagagcgcccgatggcttgaattcagatccggcccactctgagaggcaaactcctgcccgagcacaacaggcgaccctcagccatgcacacaccggctgaagcaccgaaagccgtacctatcggcactggcgacgactgccttgaggacaacggcgcagaatcaacgcggtctccggcacgatcacgccgtgtgtgatgcaggtgtgatcgccgggctgcagccgcgacaggatcatgcccccgtcgacagggtccgcgaccctggctgacatgccgcccgggtacgacggcgcaatcactgcccccgccgactgcccgccgggcggcgacagcgcggcggtgagaccgtgaccgaaccgttgtcagacctcaggctcaggcggcccttgaggaatctcaaggtgaccggccgggttgagcgggcctggacacccggattgtcgctcgcatgccgcagtgtcgaggtgccactgcatgccggcgatgcgcagcatccagcagacagtcgcactggcagccaccagccgcagccgcttgcctgacgctgtgacggcacgctccaacgtccgcagaccggcacagtcgagaaacgacacgtccgccaaatccaggtcgatgtggccgaccccggccgccagcgcttcggctaaggccacgccgagtatccccgcagttgccagatcgagttcaccggcgacgcgcacctgaattccgcgccggctggcgacggtttcaacctgcagcgccgtggctgccatctgcatcacctcgtgattgaccatagtccccgtcaatagctggcagggatcgtgaagacagcccggtgcagaccccaaccggacgaacccgatcgggaccgccccgggaccccgccgccacgcgaaccaccagcgaagacggagcgtcgaaatccctgcggcgcaagattctgtctccgtgatcagcattgccacgtcatacaggaaagcgactcatcagtaatttcaaagattggctgatgcccgttcatgtatgcaacttgcacatatgaacaatactgcatttcgcggtcggcgctaatatcacgacctggcttcccgtcggaagccgtttgcaggaaatttgacttttgttttactagctagctagaggggcaagcacgattcggtccgggtgcgccgggcgttgatcatcatggcgtccgcgtccgggacaccagtgccggcgatcgcgagcctgatcgccgggcatgaggacaccgtccgcgacgtgatccactcgttcaacgagatcggcttacgtgcgctggaccctcagtgggcgggaggccgtccccgccggatcagtgacgacgatgaagcgttcatcgtcgcgacggccacggcccgcccgagcacgctcgggcggcccttcacctgctggagcctgcgcaaactcgccgatttcctggccaccgacgccactcgcgaagtcatcatcggccgggaacggctgcggcagatcctgcgccgtaaccaggtcagctggcagcggacccggacctggaaggagtcgaaggacccggacttcgacgccaaactcgaccggatcgaggaagtcaccacccgattcccggcccgcagctttgcgttcaaccagttcgggccgttgtcgatccgcccgcaccacggccgcggctgggccccgcgatcgcatccggaccggctgccggcggcctaccatcgcacgcacggcatccgctacttccacggctgctacagcctcggcgacgaccagctctggggcgtgaaccggcgacgtaaaggcgcagaccacaccctgtccgcgctgaaatcgatccggaaagcgcggccggacggcgcgccgatctacgtgatcatggacaacctgtcggcgaacaaaacgccgaccatccgggcctgggcagttcgtaacaaggtcgagctgtgcctgacgccgaccagcgcgtcctgggccaacccgatcgaggcgcagttcgggccgctgcgcatgttcaccatggcgaactcgaaccacccgaaccacaccgtcttagctcgcaagctgcagaaatacttgcgctggcgcaacgccaacgcccgccaccccgacgtcctggccgcgcaacgccgcgaacgagcccgagtccgcagcgaacgccaacaacgctggggccgaccccgaaccaaggccgcctgacgatcagacccggtgaacgttcgtggtcaacgcactagccggcttcagcgtgatcgattccccagccggcgggcgtgttgctatcaaaccggtgggtcagtcgcaggggctggctgtgcaggccggcgaggttctgctcatcgggcaggtcgagcctgatccgcgtcggcggatcacgattgcgaatttggcggcggctactgctgctggcgcggacccgaggctgggcctgtcggccgtcgctatcacgcgcttcttccgggcggcagtcgccgacgccgccacgtcgccaaacccgtcacttcgcctgtggtcagcgttgatccgagacggtgttcccagcaacacctggcggcaatctgatccgggtagcctgccacttgacccgcttcaagctaatccgcatccggagcggtaagttccgcgtcagccgccgtctggaccggctgccatcaacgctgtcgccccacgcgtgcgggcgcccgcctcgaccctggcgaggacggcgcgcacatcggcgacaccgccgattcggcggtccccgctccacgacgcgcccacgccaactccccacgcctgtccacgctgcggggaagtgcagctcaatccgtggatcctcgatccgtttcgcggtcgaatcgaacatccgtacgatggtcagcgtagcctatgccgcctcggtggcaagtgggatggtgtgacggacagcgatagttgtcaccaggacagcgatagttgacacctcgccggccatggccggctgaggtccgcccgagcgccagacgtgtacgggtaaccctctgttaccaacgtgggagctggccacccaggatctgtagaacgcctttagccgattagcggatgccgctgcaccggcctcaccgttgtcggcgccgaccttttcgcctccgaggaccgcccggcggcgattgccgcacctctatcgtcctggctgcgggtagaagtcctgcctccacggccccattgatatcaaggcgcggaattacggttcaaagaatccagaagcacttttcctcgtgccgatccggtagatccaagcggtagggaattttgctggcctccacgatctcccggatttgcgcggcccgccgcttcagctccaatacggtgggttcgcgcgcaggccgggacgaacccggcaccggacgccggaaggctgcgtcgggatcgaggtcgtccacggtgtaagtgaccgattcggggcagccgacggccacggaatgccaagacatcttgtcgccgaagatccgatagccgaggtcggctagcagcttctcgaggatctggagccgttccgccgccgaggcaggctcggtcgtttccaccgacttgagggtcggcgccttgcggtaccgcgtgttgactcgggcatccccaccctcgtgccgcacccagaaggcgtggaggagatcattacggctgcgcagcacgtccggcgcccgcacaagcaccttgattagctcgcgggtgtcctcggtgtgggaaaagctcggctcacgcaataccgcgaggcagttgtcgacgagccaaccagcattctgtccggacgcgacaaccgaggctcgccgggtgcccatgagggccacgaagatctgctggaggcacacctcaactgcgcccgacgattcggcgatcgcccccatcgactgccaccgcagtaggactgaagcagggatgaccacctgctcggcgagatcggggtcctccgagaaccagcgatccagtcccaaccatgatccgtcttcgagtctcaccgatccatggtgctagtccaccggtagatctgtctatcgccttcggggccgccggtccgcgcaatcctcatcaggattacgcccacggcgatcgcgccgacgatgccgacgcggcctgtgacaccatatgatttggtctgcgcgtgctatatggaggttgcggcgagccgcagtcgccgcttggcgcaaacaatcatgaccgtaacctgccgctggacctcgatccggtgtagccgcgatccgggcagtttgacacgacgggtcaccacgcacggtaagggccgcaggcggcttacgccgccccgggcactccgtggactcctggacgcacgaggcgttaggtgacaactatcgctgctcgttggtgacaggtagcgctgtccgttccggagcccgtcgaggtcagccggtgtatccggtgacaactatcgccgtccgtcacagatggaccaggtcagacgacctggcgaggcgacaggggagccggcgtggggaacgtacgacccgaacgggagatcccgctggcgcgggctacatatgttgccgctgcgggccgttacctcaacgcggtcagaaacgtagcggcccgcggcgttccgatcgatccgggggatccggtgcgggagtggacggccgccgacgccgccgcacgagagatccgcgaagaactcggacttgatctgagccccggccggctgctggttgtcgactgggtgcccgcccagccggacggacggccaccgctggccaactacatcttcgacggcggccaactcaccgccgaccaactgcacaacctgcggctgcccgccgacgaactgaccgcatggcagctgaccaccgccgctgaatggccccgcctgctagccgagcacctggttcgccgactgcacgcctgcgcccacgcgctggccaccaacaccaccgcctacctgaaccacggatggcaccccaccgacccgacctgagccacccgcgccgcacggttgcccgggtggcccgggcaacaacgaacggacataccgatgaccgacacgccgaccaacctgctccactccgtccggctggacatcccggtcgccaccgccgtccaagggctgcgcagcgcgcgtaaccgggtcgagttggattggcgcgcacggtaatgtcgcggctcgtgcgaactgtgaagatcatcgttgccctgttgctgctggtggccgggtcggccggctgcagccttttcggtgacgacgcacccacgcgggacgagcagattcaaaagatcctcgatgagaacgctgaattcaccgtgttcctgcgtgacgacgccaccgacgcccagcgcaacgatgtcgaggcggcgctgcgggctctaccgggggtcaccgaggtcagctacgtgaatcgtgacgaggcctaccagcagatgaccaagctcttctcggcggatccggcatccgtggccgacgtcagcagggacgcgctgccggaaagcttcaaggtgaagatgagcgacatcgccgcggtccgccagatccgcgacgaaggcacggtcggcaagctgcccggcgtggaaagggcggtctttacctgccttgacgtgcaagagtgcaaaaagatgtccacgcccggtccgacgggatcaccgagctgatgtgattgatcggcttcgtgcctgcacggaggtccagcccggcggcaccccgtccgtgcggagtctgcctaggcacccgatgcccctggcgcgccatcgacttgatcggtccctccacggcgccgcattgtcgccagcattgatccggatagcggcagccagcgtgttcaaccgtactaggtgagctaccgcggacccagatcgtgccggcgatagaacgggcaagtccaatgcccaggactactgcaccgtgggcatcagggcgcagacgaccacggcaccagcaaccagaaatggtccgaaccggacggcctgcttccggtgtgcgcggccgcggaggatgacgaatatcagggcgaaagtgaatgacaggaagatccctgcatacgccgccgcccagccgagccagccgagtgcgatgccggcgacaccgatcgcccgaacgtcaccccagcccagctggcctggccgaaccagcgcaaccaatccgaacagaacggtcaacacaattcccaaggccagcgcctgaagccacgaggtgaaccggtgctgcgcgagagccggaatcagaagcccagccagtagcccggcaccccagaacgcggtgagaaggttcgggagacggcgcacggcgatgtcgacgcaggccaggacgacgccgaggacggcgaaccacagataggcggtccgttccaggtcagatcgggctccgaacagcacgaggccggcggcgacgagcgtgccggcttccagccaccatgccgccggtcccaccgggaccctgcagcgcgcgcatcggccggtcacagtggtgcccggcccgctcagggcgagcagtggtgcgccgcacctcgggcagcgacgctgcggggcggtgccgaagggcacgcagtatgcggttgcagaggcccgcagccatgccagcggagacagccgtcggccccagcgggccagtacgtggtcgccggtcgttccggtgggtgggagtgagggaagggaatcattgctcatgacgatgtctcagaacgcgaccgttccgtcccgctttccgggaagtgtccgacggttgtcgagaattcaccgtctgtgactgccattcgcgcggccccccgttggcttatgcctgctgtattggctgcttgcggagggcttatctggtaaccgcagcgccgcctacgacgtcctttgtccgcaaagtaccttcacggcctgacatcccattgatcactttgcgtcacgtaattggtgatcatgagcgtggctgggaagttactgcctggtcatgacattggtcaattgctagagtccggccacgcgagcgtgatccacactgggtgcaccggagcgctactccgcgtgtgcccgctagacgccatggggaggcgacgacacggcatgcgcgcactctatgcactgcgtgtggcggcagctgcgacagtccttgctggacttgcaggctgtacgcacaagtcggcggctgcgccgattccgccgcccgcgccgacttcagccagcccatcgaccgaccctgcggtagcggctgccagcgcggagatccttgatcgctttcggtcgttccggcaggcctacgacacggctgggctgaccgccgactacaagagcgaagatctcacccgctacttggaggatccgcttcaaaaagacgtcgttgcgttcatgctcaacaccaaaatccacggcgcggtctaccggggagaagcgcagtcgactcccacgatcagcaagatcgacctcaaggcgaagaccgccaccatcaccgagtgctacgacacgacgaagttcaagctgtacttcaccaagaacaattcgccggtgccggtgcctagtggccctcggcgaggaatcatcgaaaccctggccaaagactacggcggcaaaaaaggctggatgttctacaagtcccaagccttgacggatcccacatgctagcccggctggtgcaggtaacagtcctcgttgcggctttggtagctggcacgctggccgcgccggctttagccgacgacggtggcggcgcctgttccggctgggactgcggatcctggggcgatcaacccggtgcgagtggcggcaccggtagcagcactggtggtggcgggggcggcgacggcggttgtaactggctcggcatgccggtgccctgcgacggcggaagtctgggctggtacgacggcaaaagctgctacctcaaaccggtggcggaagggcccgccggcgattcgcacggcgggactgggttctggtactgggccacctgctttaccggcgtggtgctcggtggcggtttgggcgcgccggtcctgcggtggtacccgaccgcgcagggacccagcccggaagaacttgcccgccgcgccctggcgacgatcacgctgaagccgccgacgatgggtgttgacaccgccggcctcgtgttcaccccggtctggctgtggaccgccaagaccccgaacacgtggggtccgatcagcgcgtcggcgtccgcggccgggctcacggtgacgattaccgcccgcgcgagccagatcgtctggcagatgggcaacggtgacagcgtcacctgcaccaacccgggcaccgcgcagaaggcgggggaggccgatcgccggtcgccgacctgcggctacgacggttacccgcagccgagccggacccggcccggcggcaagtacacgatcaccgcgacgacctcgtggcgcgtcgactgggcgggcggcggccagaccggcgtcatcgaccagacccgggtcgccaccaccaccgtcgcggtcaaggaagcccaggtggtcaaccaatgagcctgaccgacacccgcaccagccctgccccggccgggccgctgccgttgaccggcgccccggccgcgcggatgccccgccggcgtcggcccggcctgctggccgccggcatcgtggtgatggtcgtggcgaccttgggcgcctacacctacgcccggaccgccggtgacacggtgccggtacttgccgtcgcgaccaccgtcaccgccggccaccagatcgccgccggcgacctgaaaaccgtgcaggttaaccgcggttccgggctggccccgatcccggctgaccagcagtccacggtgatcggcaaatacgccgcggtggaactggtcgacggcaccctgctcaccgcagggcagctcaccgacaaagcggtccccggcgccggcaagcagctgatcggcctggaactgaccccggcgcaactgccggcccggccgctgcaccccggtgacaccgtgcaattggtggtcacctcggatccgcacaacgtcaccgtggaccccaaggccgcggcccaggatgcgctgccccggccggtgaccgtgcccgcgacggtggccggggtcggggacaaggcgaccgacggcaacaccgtcgtcgacgtggtcgtcgccgaagccttcggcccgggcctggtcgaccgcgcgcagcagggccgggtcgcgatcaccgtggtcgcggggtagctcgtgtcgttgatcgccgtggtcgccggcaaaggatcgccgggcgccaccgtcaccagccttgccctcaccctgacctggccgcgggatgtgctgctggccgaatgcgatgcgtcgggcggcagcgttctgaccggctacctcggcgggcaggtccccgctgatcggggaatcgcgcagctcagcgtcgccgactaccacaaccggctctacgacgccttctcccagcagttgcggtcgctcaccgagaccgccccgtaccggctgctgctgcccggcaccaccgagccggggcaggctgccggcctgagccggctgtgggaccagctcggccagtatctacgcgacctcgagcgctccgacccgcccgtcgacgtgatcgccgactgcggacgggtccccgccccgcacgcgccgctgccgctgctgcggcatgccgatgccacgctgatgatcgtcggccggaccctgaccgcggtcgccgctgcgcgcacccggttgccgcagttgcaggccgaggtcggcaagggtggtggcgtgctgcggctgctggtcaccggcgccggcgactacgacgccccggagatcgccaaacacctcggcgtcgagctgctggcggagctgcccgaggacggcaggacggccggcatgttcaccaacggcaccggcgtcccccggccgagcgccaccctgctgcgcgccgcgaactccgccgcggctggcctgcgcacgctgatcgagcagcgacgggccgcggccgcgccgacgccggtcaccccgagtgcctcccgggaggacagttatgcctgaccggccgcccttgaacctgtaccggccggtggagccgcgccgtccgagcccgcgccccggtgccggggcaccggccgcgccggcgcggaccctgccgtcgctgccgtcgatcgtgacccagttgcccccgccgccgccgcttcccgctcagggccgccgccggccgccggtcgagctcgactacgaggtggtcctggctctgcactccctggtcagcgatcgcgtcagcgacaacctgcggggccgacaggtcggcccggacagccagcggcagctgaccatcgaaaccacgcgcgaggtcgtgcgggaacacatcgacaaccggatccaagccggcgaccagatcccgctcggctacgaggatgcgctgaccgatgcggtcgccgcccagctgctggggctgggccggctgcagccgctgctcgacgacccgcaggtcaaaaacattcacgtgtcaggccatgaccgggtacgggttgaatacgccgacggccgcgtcgacgagcagactttcaccgcggcgggcagcgacgccgagctcctcgagctattgcagcggcgcgccgcccgcgacggcctctccgagcggtcgctgtcgacgtcgcagccgatcctgcacctgcggctggcggacggctcccggatggtcgccgcgatcgccgtcaccccacgcccggtcgtggtcatccgccggcaccgcatcaccaaggtcaccctcgacgacatggtcaagctcgggtcgatcaccccgctgctcgccgactttctcaaggcgatcgtcgccggcaaggtcaacacgatcgtcgccgggctggccggctccgggaagacgaccctgctgcgcgcgctcgcgtccgagattgaccgcgaggagtggttcgcggtcatggagaccgagcgggagctggccctggacccgcagcggcacccgtgggcggtcgagttcgaagaacggcagggccacggtgagcgtgacgctcagggccggcccgaaggtgaactgcggctggtggacctgtttccggcgatgctgcggatgaacatgcagcgggtcgtggtcggtgaggtccgggccgcggagatcgtgtcgatgctcgacgccggcgcgaccacgcagggcaccctgtcgaccatccacgcccgcagcgctgatgccgccctgacccggctggcggagctgctgctgcgctacggcgcgacgccgaccccgaccggcgcctacatgcagatcaccggcgccatcgacctgttgatcttccagcgggtcgataagcgccccggccagccggaccggcactacgtgtccgacgtgatcgaactcaacgggctggccgacaacggcctcagcgtcgcccgcagccacctgttccgggcccaggaaccgggcgggctggcgatgccgacgggagtgcggcccaacgaccacatcctgcaggccctcagctacggcggcttcgatgtgcagcgcctgttccccgagaccgcggccgccgctggcacgccgtggggacggtgaccggccatgccaccgttgatgtttgccctgctggccgccgcaggcgtggccgggatcatgctgatcgtcgccggtgcggtcgggacccggccggctccggcccgcccggacggccggctccagcgggcccgccgatactggcgcggcgcgaacctgtcgcgccgtgaccgactgacccgccagatcatcctggtcgcggcggccgcgatcaccgtactggtgtggctgctcgtcaagattccgctgctggcgctgctcgccgggctcatcgtgctcggcgtgcgatggttgttcggcgccggcgccggcgagcaacgcgcgatcgcgcagctggaggccctcgagagctggacgcggcggctgtccgacgtcgtgcgcaccgggctcggacttggcgaggcgatcctggtcagcacccgcgacgcgccgcaggcgctcgccgaggatctgcagctgctcgccgcgcacctgcgcggcggggtcaccatcgtgaccgctctcgaccggctcgctgaccggctgtccgatgccaccagcgacgaggtgatcgtggcgctgcggctgcacgccaccgaccgtgggcagcggctgtccgacatcctcgacgagctgaccgccagcgtggcccgggagatcaccgtgcggcgcgaggtgtgggccagccgcgccgacccgcggctgaccaccaagatcatgacctgtctgggcatcggcacctacgtgctgctggtgaccaacccgacctacatccgcccctacgccaccttgatggggcaggccgtcatcgcggtctgcaccggagtgttcctcgccctgctcatctggatccgcaagctgagcaccacccgcaaggcgccgcggctgctgagcacgcaggagagccgatgagcgtcaccatcgccgcggtgttcggcgtgctcttcggcgccggcgtctatctgctgctgcgcggcgccgtgcccgccgcgcctcgcctcgacctggccctgcaacggctgtatgccacaccgatgccggccgccggcgagaaggacagcccgattgcccggtggctgaccacccggatcggcccgcgcctgcgcatcccgacccgggagctgcggctgctgggcaaaagcaccgagcgctatgtgctggagaaggtggggctgccggtcgtcgggctgctgttcgtgcccgtggtgaccgtcgcggtcgacaccatgggcctgcacctgcccgtcgtcgtgccggtagccgggtccctgctgctggccgccctgttctttctgctggtcgacatcgccatcaagcagcaagccgaagaagcccgggagcagttcgtccgggcggtcgcggtctacctgagcctggttgcgctggaacgctccgccgcgcacggaccggtcgaatccctcgagcgggcggcgcaggtcggcacctcctgggtgttcgtccgcatccgggaaaccctggcggcggcccgaatcgccggcatcccgccgtgggacgggctcagccaggtcgccgacgagataggggtgcccgcactcggcgacgtcggcgacatcatgcgtctgtcgggcaacgaaggcgcccaggtgtcgcagacgctgatcagccgcgcccagtcgctgcggatcgcgctgcagaccaaggaccacgaccgggccaacaccggcaccaccctgctctacggcacgggcagcctgatggtcatggtcctgttcgttctcgtcggctatccgttcttgatccggctgctcgcatgaacagtccccgtcccacccgtcaaggagttgtccatgtcagaactcgctgtttacgccctgacctgggtgaaggcccgcgccgcggagtcgcgccgcgacgacggggcgctgtcggtcgaacaggtcgtcctgaccgtctgcgtgctggcggcggccctgctggtcgccgccgcgatcaccgcggcggtccagggccggatcggcaacatcacctgagctgcgaggccgccgcgaaccgccgccgatcgtggtggtccgcggcggcccgcgacgacggcgccgcgtccctcgagatggtggtcatcatcccgacggcgctactgctgctgtttctgagcctgcaggtggccatgtggtcgtacgcacggtcgatcgcgctgaccgccgcgcaggaaggcctcaccgcggcccgcggctacaacagcagcgccgcggcgggcaccgcccgcgcgcaagacttcatcacccgggccggcggcgactcgctgaccggcgcccgggtcagcgtcacccgcaccgccacccaagcctcggtgaccgtcaccggcagcagcctgtccctggtccctggcctgcggttccgggtctcgcagaccgcgaccgggcccgtcgaaagatttgtccgatgacccgccgccagcctgcaccccgctggtgccgtgacgacggctccgcctccgtggaactggtcattctcgccatgcccttgatggcgctgctcgccctggccgtcatcgggatgcgtgtcgaagtcgccggcggctcgatcgaaggcgccgcgcacgacgcggcccgtgccgccagcctgacccgtaacagcagcgcggccagcgcggccgcgctgcgcaccgcccgcgccagcctggcccggcaaggcctgagctgcaacccgagcgtcgtggtcgacacgtccggcttttctgtccctgccggacgcgtcggcaccgtgcgcgtcaccatcagctgcgtcgtgcggttctctgacgtcaccgtgcccggcatgcccggcagcaagcgcatcaccagcagcttcgtttctgtcatcgacgcctaccgggcccggtcatgaccggctggtggcaccagattcgccgtgacgacggcaccatcggcctgttcgtggccgtcgccgcgttcgggatcctcgccgcgatcggcctggccgtcgacggcggcggccggatgcgcaccctgcagcacgccgacgacatcgccgccgaagccgcccgggccgccggccaagccgtcgacctgaaccgggccgccgcgaccggagagaccgtcgtcgacccgcagcaggccatcaccgccggcgagcagtacctgagcgccgccggggtcagcggcaccgtcaccatctccgccgaccggcagcagatcaccgtggtcgtcaccgaccactacgacacgatcttcctcgggatcctcggctacggccggttgcccgtggacggtcacggcagcgcgcagctgctcaccggctgacgagaggacacccctcatggcatctcgcgcgttgcgccgcacccggcagatcatcaccggcgtcggggcgctgctgctgctcctggcgatcattgccggggccccggccgcgctggtctggctcggcggcaacccgctgcccgaccacctaccggcgctcggccagttcagcgatgcgctgctacgccccgatgacggcaccctgttcctgcaggcgctgaccgtggccggctgggccgcgtgggcgtggttcaccatcccgctgctcgtggaaagcgtcgcccggctgcggggtgtgcggactccgaggctgcccgcgttcaccggcgcgcagaaggtcgccgccggcctgctgtccgcaatcggcctgctggtcgcttccccggcggtcgccgccagcggccccgcctacgccgcccccctcaccaccaccagcacggctgcgaccaccacagcggtggccgaccagccgggcagcagcccgctgactacgtccacgccaacggcgcaccacgctgccacagcccgcccgcagaccgcgccgctggtctaccgggtcgcccacggtgaccagctgtccgcaatcgccgcgcggttcctgggcaacgccgaccgctatcccgagatcgcccgggccaacccccggctggagcaccgcgaccaccgattcccggaccacatcgagggcaactggcgaatcaccctgcccgccggcgcccacgaccgcggcgcccgcgaacacgcccacggcagcgtcgtgcagcccggccatcccgaacacacacccacccccgctacgccgcccagcagcgcacccgccccgtctcgtcccgcggtcccgcagtccggcacggcatcgcaacctgcaaccgcgccctcggataccagcggggcaggcaccacccgcaccgcaacacctaccaccagcacctccgctactggccgtccttccaccgccccggcgacaccgccagcggccagcacaacggccggtcaccacaccagtcctacactgtccgcatcaacgccctccgccgagcaggcccccaccaggccggaccaggcacccgccgccggcacggacgagtccgtcgacagttcccagatcgtcaccggcgccagcctggctggcgccggcatcctgaccgcactactgctgaccggcctctaccggcgtcgccgtacccagcgccagcaccgccgcaccggccgccggctgccgcaccccgccgacggcacgaccgaacgggccatgcgtgccgccgaacaacccgctgacgtcgaccgactcgacgccgccctgcgcagcctcgccaccggcctcaccggccgccccgagcacgaactgccggacatcgccggagcgtggatcaccaccggccccggcgccgggcacccgctcaccaaacccgtcgtcagcctcatcctgacccggccgtgcccgaacccgccggcaccctggatcgccgacggcaccgcatggacgctgcccgcagacgccgaccccggcgaaccagacgacctcctagccccgctgcccaccctggtcaccatcggctcccaacccggccagcacctgctgctcgacctggaacgcctcggccaactcaccatcgtcggcgccagcgacaacaccgcggcgctgctgcgctacctgatcaccgaactggcgtgcaaccaatggtccgacgacgccgaaatcatcatcgccggattcgagcccgatgaggccgaactcctcgccgccctcaaccccgaccggatccaggccagcaccgcggtccctaccgccaccagccggctgcgccgccgctgcgcggcggtcaccacggcgctgcacgccgccggcgttgctgacaccctgactgggcggctgaccgacattggtgaggcctgggctccgcacgtcctggtcgccgccgaccccagcgagcacgaccgcaccgaactcgacgaactcggccagcaactcaccacgctcggccggtgctcagtcgccagcgtggtcgcaaccaccacgctcggcgccgccaccgacaacggacacgtcctgaccctgctcgataatggggtcttgcagatcaccctcgccgacggcggcgccccgttcctggccgcgacgatccgggcagctgccctgccccgcaccgagctcgcacccctcgccgacatcatgacgcaggcccggtcgaccagcgacgaaccagtgccggccgcccccgaacccgagccgtgggcgcagggcaccgacgcggccggcagcctcctgccgcaccacctgttcgccgccgagcccagtcccaccccgccgacgccagccgtcgacccggcacccccgcagcccgagccggagcaaccggccgactcgctgaccgagcccggcacagccgtcgacgatccgatcaccagtatcgtcctggtcgacacccggcagccggcccgccacgagccgccgacgattccccggcagcagcgtccaccagtcgacggtgacctcgacgccgacctgcgggcctggcacaaccaggacccgacccgcccgctgatcagcatcctcgggccggtcgccgtcaccgcgccgggcaccgaacccgaccgccgccgcttctacgccgaaatcgtcgtgttgctggccggccggggcacccgcgggatcaccggcgaccagatgagcgacgcgctgtggcccgaccagcagatctcgccgtcctcccgccgggtcgcgatcgcccgggtccgccgctggctcggggacaccccgaccggcgagctgtggctacccgacatgggccccgaccggctgtaccggctcacccccggctacctgctggactggcacctattccgccgcgcccgcgcccgcggcgaaagccagggcgccgccggcatcaagtacctgcgggccgccctggaactcgtgcgaggagttccgttcgacggcgccgaccgggcatacgcggtcggcgcccgcaacccgtacgcgtggctgcccgagtcagacctgtaccccgggcacatcgtgtccgccgtggtcgacaccgcccaccggctggcgcagctctacctggacatcggcgactacaccaacgcccggtggaccgtccagcaagcctgggccgccgacccagaccgcggtgacgacggcccctggcaggacctgatgcgcatcgagcacgccgagaacaacatggccgagctgcgcaccctggtcggcgagctgatgcgcgcccgagaagccgaataccccgaggacctcgcgccgagcacctacacctggctgcgcaccctcgtaccggaactgctcagcagcggaacgttcgccggatgacctctgcattcgagcttcacgcaaggcgagaagccagccacccacagttggttttgtacgcgagttccgggctctggcgcgaactccgtgattgaccttgctggctatggcgcttgggtagggcctcgtcggcttcggacgtagtccatgtattcctcgccggctacagcgtggttgacccagcggtcggggcgggcgtcggtgaggcgctcggcgagcgacatcgcttcggccccgtcgtcggtgacgcccaactcccggccttcgccgacatactcctcttcggccgggtcgagcgagatgaggttgggcaggtcgcctactcggtcgtcatcaaggtcttgcacggtgtgaagtgagacccggtattgcctgttcatggggctaatctctacccaccggatggcgggctcgtcctcgatctggacaccgccgaggaactgttcgatgccgttgcctcggcgcagggcgccgatcgcgaactgccgggtgagatagcgcatcggcagagcgtagtgccagcgcgggtcgcctccgaacccttcttcagcgatctgtcatcggctgagcccggcgtgatgatcgtgcagtctcggccggcgtacgcggtcagcggtatgagagggcgttcgggtctggaagagaccgtccccggcgggcatgctgtcacatgcttccgtccgcactccgctccaatcgctcacttatcgtcggttggtaaggcaggatggcgagcaacttgttcgcttgacaggcgagattcccggtccatccgtgtatctgtccgcgatagaggaatgcggcctcctggagaaaacgtggctacgtgggtcaacgtctacgacagcgacgatccctgggacgaagacccgccgatactcggatccttcgactacgaccgggtgctccgcttcgaccggctgcccacaccggtcggcagcagccgtgctggtatcggcacgaccggcgacaacgcctacgagatcatcaatacggaatacctgctccggaccgcatgcggccgttgggtgtgtgagcacttctttcaacagccaccgggcgagcccaagatcaaccgctggttctacaacgatgagatggctgcgacctggctacggagccgcaacctgcaaaacgtcgtcgagcactacttcggtacacccccgccgatgccgccgggcagccagccttcgcccgacggtgacccgatcttcttccagccggacgcggagacctcgagcagaatcgacgcgtacgccactgcctcaggatttgaccgacgatacggaatgtactggctactacttcaaggcctcaacgccgccgaggctgcggctggacccgaaaatcctcacacgtagtgtcctacgttgcagaggcgggtcgccgcggaccttgaccaccgaacaccccgatgatcgaccggtgaaagcctgggcgggcggagggcgatagtttcgcccccacggtgatgggatcgggcggcgaacacccgtacgatgggcggcatgacgcagcccgacacccgtgccaccctcgccgaggacatggccgcgcacggccggccggtccctccggctgggctggccagggcccgccgcaccctcgaagcggcagcgcagcgccgcgagccggatgcccgcaaggccgcgctcgagcaactgcggtccggtttgcccgccacgtgaccgagtccgaaacaccggtcgtcagcctggtcctggacacctcggcgatcgctgcctgggtacgcggatctgctgccgtcggagagctgctggcagaaatcgatgccgaaggcggcaaggtcgttatcccgctgacttgcctgcttgccgcagcgtcccagatcaccacagaccgcgaatggctgtacctgctgctcgaccatcccacaacggtcttgatctcggacgaccccgaggattgggaaatgttgtcgagcaccatcagcctgctcggcaccgctgatctagcatcggcagcctggatcgctctggattggaacaccgaagtcctcacccagcacagcgaccgatacgccaagctggctggcggaaacctcgccctccagattcacgactacttcgacggctgaccggagtccgagtccgatagtccgagccggacggcctggggacactccgccggaacgctcaatagcacggcgcggggaagcgcgggacaggcgacagcgcaatgtcagtgagcgacacgcaacagcgacgcgagctggacatttcgaggcgctagtgtcgcgtgtctgatttcgtttgacggttagcatcgtcgtcgtgagtagtgacgtggcgttctggaagatcgccgagggcgatcctggtgacatcttcgatggattggccgacgggatcaccgagcggcttgagccgcactcggacgtagcgtggtttcgtggagagttgctgtcacggtggccggacctggtcaacgtgctcgagccgaccgaagacgatctgctcgacgtgcccgaagacagcgcaaagtacgttctgctcaccttgccggtgcgcatgctcgaccggcttgacagcatcttcgatttggcccagaagtatgggttgagcggctacagcggcgttgccggccaagcgttctgactagtcgcgtacggccttggcgacgatctggtcggcggtcttagtccagcgaaacggccctagcgatctttatcgttctctggctctactgagcgccccggggcggactacgccccgcaccctgtcgccgctgatccacgaactcggcgtctgtcagtgacagcaacctgaccaccgccgggcacatcgctgtaatcgtcagcatttcctcgacctgcccgcacccatcgtcgccaccgcgctcggcccccaccaggtcaccaccgctcgcctggccggagcagcgggtgctacctggtccaactacgcgcccaacgaccaccgccggcgagagtcgtagcggtcggatgtctcggtaggtcaagatcgtcgacatggatcggtacgaaggtcgcggttggctggattaacctcgacgttcccgcagaggccctggtggatgccgcatcgtggtcggactggtgtaccgccggatgaaccggcggtcgcgccaccgacaaccccagtagcgctgggcagaagacgggaacagacgacatctagcttcgtgacatgtcctagtcgacaacctatagtcgcgggtatggcagcgaaggtcatccggctcatgggcgcacacgaaatcaggattcggttgggtggcgtgagccgccagcgcgcctaccagatcaccagccgtgcggacttcccgaaagaggtcgccgacctggcgcagggaaaagtctggctgaccgaagatgtcgaggcctggatgaaggcccatcgacgcgacgaggccgaggacggggtgtagccctcgcggagccacccgcgccggggatcgcccacccgggccgcgcccgctgatcagttcaaccatggcgatggaggcgacgctggcctcagggttgagcagcatgtccccgggccgcacggatgatctccgccggtctgaccgcgctcgacccggagcagcggcgcgctgatcacgaatccctcccgccaactcgcccgcctactcaccggcgtgcggttgaccgccggactgcaccgcgacgccctcgctgagcacgctggtgaggtcgtcagcctctaccgggcgcccgacggccggctcaccgccgagatcggcaccaccaccagcgatacccgccgccacctggccatcgaatggcccaccgggctgcccgacggatggaccgacgacacccgcatcgccgccgacgaccccggcaccggtcccgccctcgtggtcgccctcaccccggaccccgacgccggcggattgcgtaccgacctgctgcccaaccccgggcacgagccccgctacacctggggttatgacggcggcaacccccggatgctctatgccgccctggtgcgctgtgccaccgggcgatgggatcacccgcttgccagcggaaccatggtggcccggatctccagacacccggagaccagcccgctctaccagacgatcagcacccatcgcggaccgcttcgtctgcgctggcatgacatccgcagccagatccaccagcagctgcaggccctgcgcaacccggcacccgccgacgatgaggacccgcggtgaggaccaggggttccggcaacccggtcccgttgccgcccctgcccaggatcaccagccgccgcgccgacgatcctgcaatcagggcggccggacatgagtacgtcgccccgagcaagtcccgaagcgaggaggagtgacgatctacgggatcatcgtggtcatactgctactggcctacaccggcatcgtctggtgggcagtcgacgcggtcaccgcggaggcaatcctcgttcagactctgatcgccggggcaggactgtgcgcgctcatcggcgtcgtgcagatcctgcttcacgctggcgacggcccggtacccaacttcggcgccgtgtggatcaccgctgccgtgttgatcggcggggcgttggtcatctttggcatcgcgctgcgcatccaaagacacaaggacagggcgattgaactgccccgatacgatcacgatgtcacatgggaaaacgcgaccgcctccgacatcgagggcatgcgagacacttcatatccaccgcgctgaccgattccccacagaaagcgaccatgaaccttttcaccgtaacctcgggcatcctgctcggagcgccgacggcctacacaggcgcccttgcgctgtcgcgtgccgtagcgaccctcgccgagatcacggcgacccggcacgaggtgagcggtctgcctactgaaccgttcgccgcccgggtgcacgccgaccgccgacgcggggtggccgtggccgggaccagcctggctttggtcgctggcatcgcccttggggtggtcctcgccgtgaccgtcgcagacctgttctgggtcggcatctcgggcgcggcgctgtgcgcgatcgcctactgggcggcggtccggccacggcagacggccctgaggcaaccgatgtcgggcgcagacggctgacgttgatccggatgcgaaccggtgcatcagatgcgcgcgactcaccccgcccgggtgcacgcggcaccggaccgggacatcgtcgaggccatcggcccggtacgcgaccaagtagcctggccagcctgtccgacaaggcagccagtcgaaccgtcgcgcgctgcagccccggagtccgtgggttccggggctgcagcgtctccgaggggcaggcgatttttttcggctccgcctaaaaactgaccacgtggttccgatgcgcgtctcatccggcgtccgataggcagtggcactgatccacagcgtgaatgacacgaatcgaggccaaggccggactcgaaccggaccgcgtgaggtaacccgctttgcaggcgggcggccccacccgggacctaccaaggccatcatgtgcgcccccgagaggaatcgaacctccggcctccggactcggcatccggcgctctgtccccttagctacaaaggcaaggtgtgcgtgcgggaggtgggattcgaacccactcaggcgatgcgcctgctttacaggcaggcccgactctccttgtcgtcggcgctcccgcggggcgatcgagcggagttgaaccgctaccttcggggccacaacccggcgctctaccgttgagctacgaccgcagtccccgcacctgggatcgaaccagggaacctctccggtgtgaacggagcgctcattccgctgagctatgcgggggtggcggagggagagggatttgaaccctcggcgcgtcgccgcgcccacgatttccagtcgtggttccgaagccaggccggcccctcccaatccgaccacgtcggcgtgaggatcgcccgtcatggtcggagctccctcggtcagattcgaactgacaccagtacgcattaacagtgcgctgccctgcctgttgggcgacgagggaatgagtagagccgaccggattcgaaccggcaccttccggggtgaaaacccggcgaccttgccagttagtcgacggctctgtgtccgacgctggatttgaaccagcgaaacctcccgcgtgtcgggcgggtgctctaccgggctgagctagtcggacgtggcggagggcggatttgaaccgccggtctcggggttatgggtcccgcggggacgaccgagctcccctactccgcagtgccgccgggaggacttgaacccacctcagtccggattaaaagtccggtgcccgtccagtcgggcgccaacggcgtgatggtgcgtgccctcggcaggagttgaacctgctgcatctcgcttagaaggcgagcgctctgtccaggtgagctacgaaggcccgtactgcgtacgtacgccgcctcgggatcgaaccgaggtctcccgcttaagaggcgggtgctaaaccactcagctagcggcgcacccagatgagtcgggatggcgggaatcgagcccgcgaaacccctgctctcccgagccggcccgctaccaggctgccccatatcccgttccgtgccgtgcccgctgcaggattcgaacctgcgcatgtcccggcttcgtaggccggcgctctttccgctgagctacgcgggcgttgtgcgagtgaggagaaccgatacgccgggttctgtcccgcgagctgacgcccgcggtggcgaccatccatctcgtccggccgtcaccggccggatctagcgtcctacccgcgcgcatcggccgggccggccgcgcgcgtttggacttgtccggggcgaggtttacatagccggcccgtcaccgggaccgctggtgcgctcttgccgcaccgtttcatccttaccgcccgggccggagcccgagcggcggtctgctctctgttgcactggctcgcggctctcgccgggttgccgttagcaaccgccctgccctgtggagcccggacgttcctcggcaccctccccgggtgacgcgattgcctggccatccgtctcgcgtcctggtgcacgggatcgaaccgcggacctcagagttatcagctctgcgctctcaccgactgagctacaccaggttggcggagtcggagggatttgaaccctcgtcgggtttccccgatctgccttagcagggcagcgccttcggccactcggccacgactccatgagcgccgatgaagggaatcgaaccctcggcgacccgctcgacaggcgggtgctctaccactgagctacatcggcatagtgaccagccccaacgtcgggccagtgtggtggagaagaggagactcgaactcccaacctcccggttgcgggccgggcgctctaccaattgagctacaaccccttgcgtacccgcggcgcgattcgaacgcgcactgtccgcgccctgaacgcggtgcctcctgccaattgggctacgcgggcatggagccgacgcccgggcttgaaccgggtacctcgccgttacgagcggcgcgctctgccaggtgagctacgtcggcacggtgtcctcggcgggagttgaacccgcactggcgacgtcctcaacgtcgggcctctgccggttgggctacgaggacatgggccacagagcaggactgggaacctgcatctccgggcccgagacccggcgttctagctggtgcaccagctccccacggcgcgagcgcgccttgaactacctgctgcgctccgagaggaggactcgaacctccaaccttccgctccagaggcggacgtgctgccagttgcaccatctcggatcgagccggccgccgcggtggcggccggctgggggtcatgcgcgaacggccgacacccacgtgggcgtgcggggctcgaaccgcaggaccatccccgcctgccgcggggtccggtcggccttgcgctggttgcaggcgtagcacgcggcgatcgtgttgagccacgtgttctggccgccctgcgagcgcgggacgatgtggtcgaccgtggtggccgactgccggcagtagccgcagcggcggtggtcgcgggccaggaccccacgccgggaccaggccgggccgtcggtgtgccgccaccgggcgtagacccagcggacgagccggacgacggtgggtacaggccagatgccgatcgcccggtcggggacgtggtcgtggatctcggcgacctggcggacgagcatcttaacggcgtggcggaggctgacccgggtcagcggttccatgtcggcgttcaggaccaggacgtccgacacccgggtcacctcccttcgcgatattgatgttgagagcggacgacgggactcgaacccgcgaccctcaccttggcaaggtgatgcgctaccgctgcgccacgtccgcatgagagccaccggccggaatcgaaccggctgcctcggtcgtaccaggaccgcgctctaccaggtgagctacggcggcgtgccccgggcgggactcgaacccgcactgcgcgccttttgagggcgccgtctcctgccggttggactaccagggcgatcgttttgcggggtctgcccggctgtggcgctcgcgccgccccttgcgggggtagggccacgtagctcgcgggccctgttgaccgtcttcgccggtgggggagctaccgcccgccgaccgcgccgtcctagcgagcccctcgctccgggtgcaggaatcgaacctgcgtctgtgccgggggccaaaaccccgtcgagcctgccagcagcccaacccggaaggtgcttagggtgccgaggtcccaggggcggctacttccgcctccgcccggggagcaattcccgggccgccgggttggctgcgctgcgcaacgcggccgccggcaggcggcgtctggccggcccgtgcctcggcaccttgagcggacggccggtttcgaaccggcgacaacccagggtggaaacctggtgctctacctgctgagctacatccgcgcggtatgcgatcttgcaggaatcgaaacccgcccggcagacgccggccgatccgcccccgcggggctggtcgcatactcgtagacccgaccgggatcgaaccggcgtctcgtccttgagagggacgtgagcgttccgctgctccacgggtccaagtgctgggtgggcggccatacccgggggtgttcggcgttgggtgtggtgcatcccttccttgtggacctcgccggagtcgaaccggcggcccccgccatgccgaggcggtgctctacctactgagctagaggcccatgccaagatcccggggaccagccagggcaggtgcgggtcccagccgcagagctgctacctggcccggtgtgcgcggacgtgggggtgctgggtcacccatccggccaccacggcccgccggccgtcgtggtgacggcggccgggcgttcccgtgcgtgaagcctgcgagggtcgaactcgcgtcgaccggtcggggtgaccggtgctctacctgttgagctaaggctccgtccgtgccggccgccggtgggcgtccggcacggactggtcgaccaggtggttactggtcgaggggtgtcccggcggcaggcccgtggtggcgccaggcggcggggactttctcatgtcattcacgctgtggagttttcaactccccggccatgccgggacgtgtccattcccgcagattcctgcgggggacaattgagcaggggtggcaggatttgaacctgcaaccttcggatttggaggccgctgcgctaccgaattgcgccacacccctataaggaattgtcggtgaaacagaaaagccgccttcccggtccggggggcggcttcggcgcgaagggcgcttcggcgggcgctaggtgcgcctcccggtgggcttgctgatgtgggtctgctcttggtgcgccccggaggcgcaggcagccgtacccggcagcaggggctgcgggttcgcttcggcgtgccagcggtacatcgggatgctccctttgggtgtcgggctgatggactcaaccgtagggttgacgtcctggtgaggcaaatacttttcctggacgagcgtccgatcaccggccgctctcactcattatgagagtgaccagcggccgcgtcaatgcgaattaagcgcagtttgctgtggcacattagccgggcggtgagggcattcactgcccggggctacttcaaggttgttgcggtggggtcaggcatcggttattgggttgccttttccccgggcggccctggagcgtgggccggggccgtatccctgccgtcggtcttggccgcgccgggttgtcatgcgggtgacaggagttgggcggcggcggcgaggttcggctaggccggggtgggccaggtttctggccggtcgtggtgggcgtcgatgaggatgcttccgcagatgccggcgcgcaccgccccagcagtggctgcgcgaggcgggtgggtgccgtcgaagacggtggctgtttcagccgagcagctgggcgcggtgggtgaggatccaggcggccgcggcgcggtagccgctgccgtggtcctcggcctggtgcacggcgaaggccgggtcgtcggcgcggatgcggtcctcgatgtgcgcgccgatactcagcagccgcatcgcagccaggtcgacgagttcggcggcggtgaccggcgccccatacgcttgcgtgaacaggcgcagccggccggcccggtcgggttcgctgtcccagccccaggcggccagagcctcggtgggatggaacgggacgaactggtgggccgcataggccaggtcccaggcgcggctcgtgggagcggcgaagtcccagtcgatgatgccggtgacctgctcgccgtcgaagacgatgttccacggtgccaggtcgaagtgcccgatacagtcaggctcgaccgggccggcgtagtcgtggccgctccaccggcccggctccggagccacgaagccctgcgtcgcgtcgtgcagccgccgggaccgcccccgccacgccggtcagcgcctgctccaagcgcagcgcggcggcaagcggcgggtagccggtgtcgccgggcaagaacgacagggtctcgcgggcaccgtcgtcgctgacctcgagcacctgcggggacaggtcgaacccgtggtcgtgcagatgggtcagcaaggcgtgaatgtcgaccgcgcccgggcccgcggcccggtccacggcctcgccgcggcgtaccggtgcggcgaatctgccgcgctgcaccgcgtcggtcatcgatgctcccctgccggcatcacgtcgtcgtccgctcgttcgacggtagccgccggacagcacgacaccgcccgggccctgttcaaactcgcgctctacgccgcgaccgacgggagcgatggcacaacgtcgcaagacgcaccacgccctcgttcatgggctggtcgcccagggtgctgggttccggcagatcgcgcgtcatctgggctggagccacaacacggtctcccgctacgcccacgccgcgacctggcaggaactcgtgaccacccagaaacagcggccgagcctgctagacccgttcaagccctacctgatcagtcggatcgacagcggctgcctcaaagccaagcttctgcatcgtgaggtcgtcgcccagggcttcagcggcggttacggcattgtcagggccttcatcgaacagcaccggattaagcggccggacctacgaaaggcgtcccggccactgtcacctcgccagatcaccggctggatctgccggcaccccgacaccatcaccgagcacgacatcagccggctgcagaccgtcctcgatcgctgtccggaactacgcaccgctgcagacctcgtccgcttccttcggcgagatcatgacccaccggcacggccatcgcctcgccgactggatcaacaccgcagaacaagcagagctgcccggcatcacccgtttcgtcaacggtgtgaaatccgacctcgccgccgtcaccgccggcctcaaagcaacgtgttcctagataggccaagactttcatttgggcctagccagcacgatgcctctgagagctttgtgccgccgggctactccagctccaagacgatagcgtccgggaagacggctggttcgcagtgtcgatatgccgtggtcagggcccttgagggcaggccgagcgccgcaaggagctcctcgtgctgaacctcggccatcacgtgcgcggaggtgccctcgttacgcagggcagcggcgatcgcgtttaaatcgggcacaccgaccgcgaacgaggcgaaagcggccggatcatcgccggcagggcccttggggattttgaagtcgaccgagtggacgacaccatcgatcattgggtgaaactggccgtcttcttccgggacccactcgaccgtcatctccacgtcgttgatgtatgtgtggacgattccgccgtcgcgaatcacgtagcagcagaggagatcggaatcgaagaccgacatggccaatgccggacagctcaggcttacgcttagcccctcgccgatcgagcggacgggagcttggtcccactcactctccttgggcagtaccgccacccgatgctcggccagcggcactacgactccgacgaccccggcgtcgcacagcgcatccacggtcgcgtcgaaatcagcggcgaccagtaatgtctggtatgtcgatcccattgcgccacatgatagccgatcgtcaggaaacttagtcccgccgaggtgtagccgacggcgattgcaccggacatacatatggcccgctcggactctgaaaaggggcgggaaccaacaagggcacccgaaccgactcggtccttatcggcgcatcgatgaacacggaaccaaactaatgagaacactacagtactagctagctagaccggagtggtggggcggcagcgagccttcgagccacttggctaggctggcctcggcgtacggctcaaacggcagcgccgcgttcaggccggaaggtgcattcacgctctggaacgacgccgtatggctgggtcacggcttggtgtagcgtcggcgtgggaacacgcggctgagccgcggcaggcgctggctgatcgcggccaggctgtcggaatcccacggcacgccatccggtcgagggtcgaaggggcggatgtggccgcggtcgagcagggcgtcgtcgatgccttcctcctccccggtgacgcggtcgtaagcgttggaagcaacgcatgccaactgctcccaatggggccacgcggcgtcttcccattctccgggctggctgccagcgagtgcctgcatagcggggagctcgaccaggttgtccgggtgtcgggcagcgtgctgccaccagcgccggccttgaccgatgagccaggtttggaagtaccagaagctgtcgccgctgcacaggccgtccatgatctggtttgcggcggcccacatgtcgtaggtgtcgatagggcgccgagcggcatccaggtggatctggaagtcgacgacgtgagtgagggcgatgcggctcagccgatcttccagccaaagcgctcgccggtttggatcagattcggcgtcggccgaccgttccacgaagcgccagaaatctgccacatccacgacgcgagactttatgtgaccgtcgggacgaacggcgccctaagttccgccaccagccggaaagaaggagatgacgatggcagcgtcgaccacgcagcgcccggcggcgctgccccatcccgctgccacgctcagccatcgccgcgaccgtctccgccggccagacctggatggtctgggacgaccacgacccggctgccaccatcaccctcaccgcctacgtggacgtcgactcgctctggaaacccgaccgtgaccccgaggcactctggtatcccgaagacgatccggccgacgcgctctacgccgccaagatgatggcgccgctgaaccggtcaggatcgcgccttggcagcgagatgctcgactgggcagccgggcgcgcctgggacgccggactcacctggctccgattcgacgcctggaccaccaacccccgcctacacgcctactacgtaggcctcgggttccggcacgtccgtaccatcgcaagccgcgtctccggcgcctgcttccggcgcccgagccagccttaccacggctatctcaagaccgacggcgaatagccgtggtgccttcgcggcaggagcctgcaatgcctcgcgggctataaggcagcagcagaccgcagggcagggcaactgggaaagatcagcagtcggggcactccaccagggcacatggccggtctcggagccggacgcgtcaacgcagcagcaggatcagggccaaggcgatggtcggtacgacgaccagcgtggtccacagggtgactcggatgccccgccggtgggccaggtaggtggtgagtcgggcggtgagctgctggtgggcgatgaggtcgtcggcatgtggtgcgcgctcgggtggcagcaggggctgggcttcgggtgcggtgagcagcaggccgatggccgcctcgaggtcgcgggcgtatagctgggctacccggattttcgcgagacgccggtccccaacggtaggtccaactctcgtacgcggcggccctctgttcgacggctttcgggtggtcggcgagcgcccttcgcgagcaccacacgggagcagctggtcccctgctgagtagcagcgcactaggttcgttggtggcgcatcggaagatcgaaagtagaaatttccggagttgcggcaaccttcccggagctccaaagcgtaggtagtagtcgtggatttggggctgatggcgtgggggctgatgatgtggggggctgatgcgcgatcgcgaggatagcgaggtgacagccttcgtgcgagcgcgttacggatcgctgctccggaccgcgttcctactgtgcggcgaccgcggcaaggccgaggatctggttcagacgacgttggcgaagaccgttgtggcctggtccaggctgcaacgggcggaaagcatcgacaactacgttcagcgtgttcttgtcaacaccttcgtgagctctaggcggcgacgttcctggtgggagcagcccttaggccggctgatggatactgcggcgcgcgacgaatacgtgactgtggaacagcgggacttgctccgccgggcgctggatgggctgccagcacggcaacgagcggccgttgtgctgcgctattacgaggacctatctgagcaggacaccgccagcgccctgggatgttcggtgggaacggtcaagagtctttgctcgaggggtctgcaggctctgcgcaagcagtgggttgcagcggaagcggttactgatcaaaaggtgcggaattatgcatgacacgacggagttgcgtgacggcctggtagatctggccgagccggtgctaccggtcgagggctatgagaaccaggtcatgaggcgagcggcccgactacgcggacggcgccgagtcgcagccggggccggagctgccgtgtgtctggcgattttggcaacgatgttccgggtcgttggattcggctccaccgccgaactcgcggcatctccgccggacggcccgttcttaggttggtctccggtgggagacttagacgttggtctagtgcgcgacgccactggcgtctgggaccatgccagctcgacgggtccgcatacggccgtccgggccctcgtcgcgatgcacagcccgcgcctacattcagcggtggtcgtcctggagggatacgacaagcagggagccgcacggttggccttcttcaccggtgattccggtgcggcggacgccctgcggatgcgggtcgaccgaccggcgccagacccggtgaagacgcaggtcatcagtctggtgagcccccggttgactggcgctccgggcgcggcaagtgttgacctcgcgggaacctccgctattgctgtggctatgccgggggttaccgcggtgcgtgtatcgagcaccgcgatcgacgatgaaatgacacaagatccggacgggcccactagccgccttgttgtagagcgatttccgatcactgcgacagcgcaaacagtgacgattactggcttcatcaagccggataggcccttcgctaaagcgacgaaggttttcgaagttcccggtgaagatggtgttaccggcgacccgcgagccgtgcctgcccaggtggtcgctagaggtggcgagcagttaatcgtggcgttctcgacagatcaggcggttcggaaggggcagctcgctgtcgtagcggcaggtttggtcggacgggttggggcagtagacgcgacgcgcggccaagccactattgacctggttaccagtgccggtttcgcaggccaggtgtataccgatatcagcaacgtcccgggatccgtgcgtggcactggcggaggtttggtgatggaaaatgtgccggcaggcggtgagatatatcaggataatcgcgtcgtgatgccggacccttcccaacagaacaaccagattggcgctgtcacggttggacgagcgtctgcagagaaggtggccggagccaccacggtgaaactcagccctacagctgatattgcacatataacaacgttgtccattatgacgccgccagccggcggcggccgctaaaaaggatgcgcggaggcgagttgcctccgcgcatctcaactattcaggtgacgttcacgaatagcggacccggccgctaccggaagcctttgcgatgtcgccattgacattttccgtagagtaatagtagaagttgatgatcgtgttcgtcggaacgcccgaccagcagtaggaacgcgccaccccgtcggtggggacggtgacatccgagccgcgaaggccgactttgaatttgtgatacgaaccttgaggaatatcccactcggcttcaatgtccatgcagaccgtcttatgggcagacctgaactctcggccgtcgtggtcccagaaatgagtgaacgtgaaggagaacggaagtgtggcgaccgcgaaagtcgatactcccgttgtcgttgtgggaccgtcctgggtgtagtggtcaatcgggccctcaagcttcggcagtttccccataactgtcatagttacgttcgacggcagcgacgcccgcacggcggcattgttggcctcaatctcagcagcggtaggtgccggaggtttcggcgtggcgttggcggctcccgccgaaggtgccgcctgggccggtgctgctagcagcagcagacctgcggtcgcagcaacggcaacgccagcgagccgcttcgagtgcagatgtgacacttagtaaccctccccgtgggtttcggtgttgttccgatcctgacaacggtcggtcaactgccacaagggccacagtgatctgtctcttgtgttgcttgtcatcgatctcgaggcggggcaccccagcggagacgtgttaaggcgaacgtctcgtcgctcgggtgactggaatgtttccgtcgcaggcgggcggtagcgttgtgccgttccctactctgatgtacgcaaggtcgtactagcgttcctgggtggtggcatgagcgaggttgatccgtcagccctgatgagcttggctcaggagttgcggcgttcgttaggggatgcggcggagacgcagcggcgggtgttgagcgtcaccgggtctgcgacgtcgccggatgggctggtgacggtggtggtgggtccgcggggccagttggtggatttgcggattgatccgcgggtgtatcggcggccgaatgcgggtgcgttggcggcgacgattctggcgacggcgcgggccgcggtggagcaggcggtggagcagacgcgggagttggtggatgcgcggctgccgaagatcggcggtctgctggcatcgggtgcacagcgtccgctgggggtgcgggacttgatgcgggcccatgacggtgatctgagtcgggtgctggatgccggtgaatggtcgtgagcggccggtgatgccgggtgcgtggcaggcgatgacggtgatccatcccgggtcggcaggtctgcgggtgcggtatcggcagggtgtgctgatcgatgccgccgggtttccggattgggtgttgtatgcgcgtacggtggtcgagttgccggcgccgatcgccgagttgaccggtgatgagcaccgggttttcgatgtgctcgcggcgaatcgggtgatgctgggtgctgatccgctgtggccggacctgcgggtgggtttgcctcacgcgacggcgacgccgccgggctggtgctgggcgcggctgccggtgagtggtgagcgggcacggcgggtggcgttggtgccggtcgagttgcacggcgcgttccggcatggcggcggcagccgtacgctgccggtgggccggccgggctccggagtacggaccggcgtggcgccggtcgagcgtggtaacggcgaagtggtttccgagccgatcattgctgaggtggaggcgttgctcgggtacggcctgccgccggcgtatcggcgttttctggcggcgggtaatggtgtgggcccggccgagccggcagtgtcggcggtcgcggggatggtggtcgatcagccgctgttcggtttgggccgcgacgacatgctgcaggatctggggtatgcgccgcggtggctgggggaccggttcacgggcgaattcctgccggtcgggtttgtgcagggcgggatcctcgcgatacgggtggctggtccggatgcgggcagtgtgtggttcttcgacgacgacgatccgcgtgatgacgacagtctggggccagcggagatctgcgggcggttgttgcggcgctgcgccggggacttcgacgagttctgggcggggttgcggcggccggctgcggtgctgctggaggtggtcgaggatctggtggccggcgggctggtccgtgaggtgcggccggagcttgccggtgcggcgcttcctgaacggatgcgtgccgagtggcaggccgtcccgcagcagcgttcgatatctgtcgatgatctgatgttgtaggttgcggggtgtgggcggggcagcgtgggcagcggcgaacagtgctgagcggcggctggcgcgagcatgggcggatgacgacgcggacaggttcgccgacgtactgctccatgctgacctgtttttgccgggcttcgccgatgacggtgcgagcgggcagcggctgctgacccgtgagcggggtggccggacgtttctgctggtctacacctcggtggaagccttgcaggaggcgattccggcggtgggcgtcggctggcggcgcacgacgttcgccgagctggccgggtcgtggccgaacccggcgtggggactcgccgtcagcccgaacaccccgatcggcgcctacctggacgcggagcaggtgcgtctgctgggcgaggaggtggccgcggagcctccgttcgcgccgggtggtgagcgggagcgggcgatgcgtgccgcgcagcgcgccggtgatgccgaggtctatctcgatctgctggtcaccgcggacgtgttgctgccgctggccggtccggccggtgcggatgatctcgggaagccgggctttccgtggctggtgcagcgcgccgcgggtgtggccacggtgccgctgttcacctcgcggcagcggttacgggatgtgtggcccgattcggcggacaggcccgcggttgtcgaggtgccgctgctgtcggtggtgcgtgcctggcccggcgccgcgtaccggatggtggtcaacccgggctcgccgatgatcgccgagttcaccggggcccaagtgccggatctgtggcgctgggcgcaggaactggtgctccgtcggacctcagcctcgcagagcggttctgagaacgagccgctcgctgagcagccggtagtggccgggccgcggatgcgccgggtgcaggcgctggtcgaccctagcgtggcgttgggctggttggccgccggtggcgggcggatcagtgcttcggtcgggccggctggtgcggtcgggatccttgacgggtatctggtgcgctggcacgaggacgagactctcggtgcggcaacgcgcccggtggtggagctggagctgccgtacggcgcgcagctggtccggctggtagccgggcaggagatcgtggttgccacctacgatgccgagctgtcgtggtggcggccgtcgatcatgagtgtgttgcgtggtgaagcgcggtgacagctatcctccgtactcttggcatgagtcaggcacaatgagcttcgatccgggcggggagggtttgcgtcgatgagttcgtatctggagttgccggagggcacggaagcggtcgcgcagatcggtgcccggttgcgggcgcaagcgcaggatttcaaggagcaggcgcggcagatcctcggtgacatccaaggcctcgaccagggtcagccgtggggcaatgatcaggcgggtaaggcgttcgctgagcagtaccacaagccggtggaaggcgccggctcgctcgcgctggccatgcaggatcggctgcctagctagctagggtagcgaccgcggccctgttcggcggggtgctcggggccaaagggatgcgcggaggaatccgtgacgccggcgccgacctgcggctacgcctcggcgagaacaacgctctgggagaactgggcacgccgggtgccgaggcgggcgtggggtcggccggcgacatcgggtcgcaagctgggacacgggctgctggcgagcccgggttcgaagctggcccgcggcccgcagccgatcacggcaccggcggcagcgagcagacgtcgaccagtggcggatcagagcactctactggcagttcgggcgccgaccagcaggcgcgcggcgaatcaggcgatcgtgcgagcaccgagccgggccagcgcagcgagtcgaccgggggcgtgcagcaggcggagccaggcggcggtccgcagcgggccgaaccaggcaccggtgagcagcggtccggcttcggtgacacggcgcgggacgagtctccgcaggcgagtggcaagccagagcagacttctgccggccagagcggcacggcggatcgcggcgaccagcgcgtggtcgaacccgatgggggaggccgccaggagaccggccacccggaccggttccccgaggcggccaacgacagcgacaccggccgcggcgacatgtctgcaggttcggatcgggccgtgccggagcgcgcagcggatggttctgacggcgtagctgacccaggccgggaggcgcagcggctggccggcgctgacaacagtcacgctcgggaagtgcacggcgacagccgtgaaggcacggcgggggccggacgcggtgcgccggccctccatggagcgcgattcgagggcgccgatggtggcaggccagctgaagccggggtgccggcgtatgggcggcacgccgagatcggcggcccccgcattcccgaaccagccgcagtccgatccgcagtcccagagaccgcattttccggtggcgagccggcacggccggttgcaccggaaccgatcgcggcccggaccgcggagatcggccggtccgacctgtctaccccccgacctgccgatctcgcacccggcgaaaccacgagcccccgcacggaaggcccgacgccgcgaatcgccggtccggaccggccacccggcgaaccggcctcatcggcgccgggccgggatccgcgcggcgacacagccggcacgaaaccggacggcagcggcccggaacgaccggcgcgcgacaacggcaacagccgtaccgcgaccggcgatgaatcccgtgaccagggagaccggccgtcgcagcgagacgacggccacgatgatccccgtcggcgggcgtcggatccggacgggcggcgttggcgcgactacgcgcggcggatccaacgctggtcggagaaccgggccgctgaccaggcggcgatggaccgtgcgctgttccgccggttcaagccggagcaggacggcaccgcgcggctacggccggagacagtgcagcgggtcctggacaccccggccgaccggttggacggcaccgggcagcggttcaagcagatggtggaacagcatttcaccgatccggcgttcaaggacggccagccggtccggcgctctgcctcgcccgacgacatcgccgcccggctcggcgagctgcgcacttcccgtccgcccagcctgactggccggctgctgcacatcgacaaactgcgtgacgcgctgccggattggccgcgccggcttccggagctggatccgatccactccgagcatgtcatcggcggcgagtatcacggcttcggccggccggcggacaccgtgtcggtgggccgggagatccgtgaagcggtgccggaagtcctcgaccggctgttcaagaacgtcgacttccaccggcccgaagacggcggccctgacgtgctccggaccggcgacggccgtgacatcaaggtcgacttcggcgccgaatcgatggaccgcaagcacgtcggcacctccgagcgcgacagacgcggcggcatgtggcgggtccgggcgaactcggggaccaaacccgaacacatctccaccgtgaccagccacgaactcgccgagatcctgcagaaagagcgcttgcgagcggccggcgaacggtttccacccaagaagaacatgctcagccccaaggacaccggcgcgcgggaactgagcccggatgaccacggccggatcgccgagatgctcgactggcacgaacgctcgctgacgggagaagcaggagcgcgcgaccggctgggtgagctcctcgaccacctcggactgcgtggagacgagtcgcgcgctgttgcgagccgccaggctgtcaccgatcttctcggcgatccgtcggcgcaccatttcagcgatggtgccgcagcccggttcaacgacctgcttaacggtccggcacgcgatttgccgcccgcacccagtgtgcggactttcaccgaagctgatctgaagcttccgcctaccgacgttcctcgtccgccatggatggacgagtccaagaccatcctggtggaggcccaccagcagacgggccagtcgctgcgataccacgtcgtgggggacgccgcggataccttccgcactaccgacggcacactgcagaagtacgggcacggccgacccgagttcctcgacgacccgttccgtaaagcgaagggctgggacgtcaccgcggagaaggacaagttgccggaacttcgacatgatccggccgctgagcacaccgggcagatcgccggtgacagcaagcagtaccacgatctagcagatccactcgaccgtgcggctcgcgatcgtgcggcgaagatggacgatctgaatgccgtcctggaccgcattgaagcgcagaccgggcagccggccggcagcctgcgacacgtcaccgccgacgatctcggacgtagatcatttgccaagaccagatcgagcctggctccgctggccatcgagcatcccgagttgcgctcccgtatcgaggcgctgcaggatgcggtggacgactacgccgacctgcatcgcgaccgcgggatggcctccaaccgcgtcggtatgatcgccggccgcgagtatgccaagtcgctgggggtgccggagggcgacatccacggcgaggtccacgacgatccgaaatcaggggaactcgacgtctggggtgtggcccgcgacgaacacggcaacgccaccagactcgttgtcgtcgaagccaaaggtggcagtgccggcctcgacggccgggaacgcctccagcaaggcagcggaccctacctggaacgcgtcatgcagctggacaagaaattccagctgttcctccgcgcccattcggacatcgcggcgggacttcgttccggtgcgatccgcgtcgagtattacctggtcagtcagccgcacatgcccagccgcggcactgtcgtgccacccgccaaggtatcgcaattccggttccactaccgagacgtcgaccaggacttcggcgacgaccttaacgtgttcgacccgcgcaacatcgggccagaactgcccgaatgaagccggtagggtggtcgatggcgaaccagacagtggtgaacggaggtgccaggatggcagcatggcaagccctcgatgaggagcaggtgctccgagcggcacaggaacttctgtctgcctccaggctactggcaactcctgcgcaggaggctgcggccgcgctcggctggacagtcaccgatttcacccgccgatcggggcttctcgactcgggatacggcctcgggccttacagcgcgtatttcgccatcgaccggcagggacgtcttgaggaggtgatcctcaatatctgtgaacgtatcccgggcagcagccctgagatcgacgccttcaaacaggacacttttgctgcggccgccagcgtcatgaccggtgtttatggcaagccgaccgatctgcagcccggcaaggaacccgagctgtggtgggatcagggcgaggtcacgctccgtctgattaccacccaggacaccgtcgccctgcagatcacccccaccgagctgctccaggaaatctgacatggcgggcgaggactgggaggcgtttcgcaacggactggcgcgcagcttggcggtcttgcccgacggtggtgcgttgatcgtccgcgatcaacaacgcaccgtgtgcttcgtgcaattcctgttcaactacgaccacatccgcgctgaagtagcaagcggctgggatctgacacatcaaccgaacctgacgccggaagagttcgcggcgatcgaacgcatcggctggttgtcaccggtacacgaccacactcttaaccatggcctcaacatcgcttggccggcaccgtcagcggagtatcgccgggtggccgatatatcggtggtcacgttgcgcgacgtttttctggtgccctcacccgctagcctttgctaccaatcgttcatctctccgggtaacaggccactattgatgcacagtctggggatcccgctgcaggaagggaaatcgggtcgctgacatgtcgtggccgtgttgcaggaagttttgggatccggtcgccggtgtcgctcgcctacaaagcgttcatcatctcgattggctggaacgtgcccatttctcgtgggaaactctttcgcgccctgatctgtggacctggcaacaggcgtcctgaggaaggcaagctgccgcaattggcagattttgcgtacgctactgcggacatcgtcaagcagatccttaacgggacgatcacgcttcactatctactggtcagtcacggttatgcaaatacgaacaggaaagtgccgcacgccaaggtatacccagttcatctatggcaatccggattaccgctaaaacgccttctgccctcgcggtatcgacccaccagcgacgtcctgatcaggcgctaaggtgcaaaccgacgacgacaacggaggtacgggacagtggctgactggcaggcactcgacgaagccgggatactgcagacggcgcagaggttgttgtctgccgagccgtggctgatgacgacctccctcacggacatggcggccaggttcggctggacggtgtcgaatttcaatcccgactatccgaccctgggcgcgttcatcgatgacggccgggggctaggcccggaaagcggcttcgtgcgcctcgacgagcagagccgggtgcagcacattttgctcagccttactgaatcggtggccgaggaaggccctgacgtcgatgcgttcctgcaggacgtattcgccgatgcgaccgcagccctgacgggcgagttcgggcgtcccacgccaaccgtgtacggcgaggaaccgcagctgtggtggcagcgcccggccacgatgttcgggctgctcaccgagatcgacgcggtcagcctgcagttgtcgccgaacgagctgatgggcggtgagtgggagtgaccgacgtggattggccggcgtttcgcgatgctttggcacgtagcatcgcgaccttgcccaacggtgccgcgttgatcgtcagcgacgcggaacggacggtgtgctacgtccagttcctgctcgaccggaacaccgtcaccgccgaggtggccagcggcctggatcggtgggaccgcccgttcctcaccgaggaggagacggcgacagtggaacagatcggctggctgcccccggacaatccggtggtcaaccatggagtgaagctgacctggccgacccgttcagccgagtgccgccgggtggccgacatgtcggtggccgccctccgcgacgtcttcgagatcccgtcgcccgccaaccttcggtacaaggccttcaaggtcgcgggcggcgccggcgtgccgatgccgaagctcggcatccccgcccgcaaagaccaaccgccagcgacacggtgagtcggtccggttcggcggcgggcaatagttgcacgctgagggcgagtaaggccgcggggccggctccggtgagctgctgcctccctgtgaagggtggtccacggtgatccgtccgggcaagatcagctatctggtggtgcaagcctcggaaaccggcggtatcgaggttaccggctacctgactgatgaaaccgtgttggaccgggcgaccattcagatggccggatcgcagtgacaggaggcttttccgtgacctaccgggtgatcgacggccaggcgctgaaagacatgctggttgtcatccgcgagaccgactgggactggtcggccacggccacgcccggcctgcttgcgcagctaggctgggatgtcatcgaggaacttcctggcaaagggttggaagcagagacccatctgggagttgagcccagcaccgtggtgctgggattcgtcgacgggaaagtggacaccctgatggtgtcgctgaccgatctgcttcccgcgcaggaaactgccctgcggcaggatgcgttcgccggctgtgtctcgcaggccaccggcatcctcggcgcaccgacggatcgccgcccgggtgtatcgccttcggccagctggcgaggtccgatcgccaccgtcgaaatccgaaaggtcgacagcggcgtctacctgacctggacccataacgccttcgccgacctcgtacggtctgtcgaggaggactaaccggtggagacgaccgactggggcaccctcaccgatgagctcgtgcagcacatgttcgagatggctgaaggtgatgtgctgatcctcagctacggtgcgcactacgtgcagatgaagcagggaccgcggtggctgtccatcgaagcggtcgccaacgaattcttgcccgatgaagtcagattggacgaggcggggcagcgacggttgaccgaactcggctgggcagcccccgacccgcctgccagttacaactggcaccaggacaccgcattccctatccgctcggacgaagcacgccggctcgctacgatgatggccgtcacgctggatgaagtctttcgggtaacccatcccgccgaactgagccgcgacgaatttaacgtccgcaccgtttgacgcggccgcgtcaatgacgatccgaattcctgtgaactcggcattcgaggcgcgagccggaacgtcacggaaacgccgtcctaatcgtggtaaaggccaagggtggcatcgtcggcaccggcggccgcggccgcctgcagcagggcagcgcactgtacctggaactgaccatgcgactcgacgcgaagttccaggcgtttctccgggacaacccggtgatcgccgaaaatatccgcatcggtgtcattaaggtcgagtactacctggtgagccaaggttatgcggaggcgagcggtgtcccggacgccaaggtataccggttcatgttcgacggcgtcgacccgggcaatgtcttcgaacctggcaaccccgacgttccccgggcacggtcaatgcgtcggtagggtagctcaggcggcatgacggaggtaggaatggttcagtggcgggaggttgacgaagccacggtgttgcgggtggcacagacgctgctgtcgttggaaccgctactgctatccgcttcggtccaggaggtggcggccaaggccggctggacggtgacccgtttcgacccggaacggccgaacaggagcgcgttcctggacaccggatacggcttcggttccagaagtgccttcttcaagactgacgccagcggcaaggtgacatccatcctggtgagcgtgaccgaggaagtggccgggggcggcatggcagccgacgagtacaagctggacgccttcgccgtcgcagcctccgcactgaccagtgctttcgggaaaccggaccgaccccggcccggcgaagaaccacagctgtggtggcaacgggacacgacgtggttcggtctgatcaccgaacacgacggcgtcagcctgcaactgacccccgccgaacggatggtgggtgagtggtcgtgaccggtctcgactggcagacgttccgggacggcctggtacgcagcatcgcgtctctgcccaacagtggtgcgctgatcgtcggtgacgaggaacgtacggagtgtttcgtgcagttcatgctcgactacgaccatgtcgtcgctgaggtagccagcggcatggacccgtgggaccggccgaaccttacggagcatgaggcggccgcgttggagaagctcggttggttaccgcccccggagctgcaggagcattgcaaccacggggtgaagatcgcctggccggcgccttcggcggagtaccggcgggttgctgacatgtccgtggctgccctgcgggacgtcttcgggattccttcaccggactcgctggtctacaaagcgttcgtcgtcagtgcaacaggcgaccccctgcaaatgccccgcctcggaatcccataccggcccgactggcgttcctgagcctcgcggcggccgccccttgacaagggagccggttcatgggcgggagtcgtcttcgctgtaggtggcgccatggacacggcccaggcgtaagccgcacccagccgtgctatggaccccgaagtccttcacgatctgctccaccgtcacgccagggtcccggtcacgggccacccgcacgacgtcatcgcggaactcccggggtagggcttgggcacagcaacatcgagcaatagtcaagatttcttatccacaagtcttgactattgctcgtggctggctcgtggctggaacgtcccggcacactgtcatggatcggcgtgcgttccggcagcggctcatgcatcttctgatgctgcgcatgcgcgttgccgccatgtgagctgcaatagcgcctacagcagcagcgagcacccagtctaggactcgaccctcggcggggtgccaaccttcggtaatccgccgccactgaacggcccgggcgccagcacggctgccgtgtacccctcgagtgcggccggatacgcctcgatgaatcagcgcggaccatgccaccagtagcacgcatccggcaccaccatggcccggagggcgtgatcggcagaccctagatcacagcaggcacgttgaggtcgcgcgggaaatcagagccatttcgcaagaggtaattgctacgtctgccctgttatgagccgtatggtgacgactaccgctgcacgcgcgctgcaagctcacgcatcacgaaagaggagagcatgtcgaaccagcagccgcccgccataaaccgggacttggtgacgaccctgaccgcggccgcgctggccgccgccgcaccggaagagctgacgatcctcaatgagatcgccgaggagtacttcgccgacccggacgcggtcctcaatcctcgccgacgggatgaagcagtaggcttcggcgtcgatctggcactacttgctccttatgctctggccatcgcgacacccgtggtgcacttcctcatcgagacggcctccagtgagatgcagaacgccgcgaggccgttggtcgcccagacggtgcgccgtctgttgcgccgttccgcaggcgaaatggacgcacccagcgcgacgcccttgaactctcaacaggcccgacgggtacgggagatcgcatacgaccgggcacggcagctcgacctaccggaagcccagtgtgtcgtgctggccgacgcgatcgccggtgccatcctggtgtccgcgtgagcgatccagacgcgccctcgtcgaccggcgatagcccgacccggcccaacgggccccgtcccaacgtgctcgcctgcccttcgcccaccaccgcacgtttcatcctgctcgtggtggcgacgttggcgaccggcctattcgtcggggtgttcgtacacaacatggtgctcggcgaccggtggcaacgcgaggttgttgcttgcgcctccgggctgccctatgccgaggccgagggagccgatgtcctaaccacctggcaggcttgggccgaatgcacggccgacgccgagcatcgacgcgcgatcttcgccttcgccggcttggccgtcgccgcagtcgctgcctttgtaatcttcaaacgctctccccgccgcctggagcgccgccgccggctgcgcccggccgacgagaggttcgccgcggcgcggcaacgattcaccgagctgtcccacgccgctgggctgacccggccgccgacgctgatgatcggccccgcgacgcagcgggacgctttcagttacggacttcccggcagccagcgggtggttatgccggtggccgcgctcatccgaccccagtgtcccgagttcactgccctggcggcacatgaactcgcccatgtggcccgccgggacgtcaccgtggcgtgggctgccaagtcgatcggatacgccgttgccccgctgctactggtccccgctctccttgccgtattgacgggtgagctgtcgctactaaccgactacgtctggcgcgctgtcctgctgggtgcggtagttacgctcacccgtgcagcaattctgcggtcccgcgaacacgacgccgacctacttgccgcccgtatgggaagcagcgtccccgaactttcggccgtgctggcccagatgcccgacatgagaagccggcacctgcgccacctgatcgccaaccacccgtacgcccaccgccggatcgccgtgctcgacaacccggccagcatcgctcgggcaagcttcgtggacgccgcagcggccgccttcctcgccggtctgatgccttacctcatcgaccttgtcgtcgtcccgctcttgaccggcacagccggcgtcggcgttactgacctggtcgccgccgcggtaatgggaccgttggtcggcgcgacgatagggctcgcgtcctggcgtgcttgcctggtaagccgagtctccggtgctgctgtccatcggggaccggtggccgccggcgtccttgtcggctttctgctcggcgaagcggcatcgctcgcacagtacggtccgggcgggtaccacccacatcccagcccgctactcctgtccgtgacagcgctgtccgccgtgggggcgacggtggccacagttggcttgggagagctgtgggcggacgccgccggccggttacccagcgcccgcagtttttggctgaccgcggtcctggtgccgggcctactcttcacggcaacgctctgggcggcgatgaaggtgcaaaagagtcttgagtggggtggctggggcatggcgagcctcacgctgacagactattttgcacgccccaccatggtcgtagggacactggtactcgctctggccgctgcctggccgatatggttggcacggcgcgacacggtgaccccggcatggttgctggagtccggcacagggcgctcctggcccgctaccgaccgcccggccgcccgcttcaccgtcatagccgggttgctggctgggacctgtggcgcggccgtcatcgccgtgttccgggcgctggcgggcgcggccgcagacgacgctcaggcggcccaacgcctatacagctacgtctttctcgcgggcgccgtcgcagccgccgcgacgatcacagtggagtgcttctggccgggccggggtgccggagctgcgctgatctccgctccggtcgcagcggttactgcgatggctggcctcgtcgtgatcaacacacttctcggtggcaccttgacatggaccttcgcgtacgacatcggcagacaaccgatcggtcttgcactgttgagtcagacattcgcgctcagcatcgtggcgttcctgcccagaggacgccgcacttcgcgcagaatcgggctggccgccattgtcgtggtggccacactcgccattctcgcagcatcagctgtgattaccgcgcgcgacgtgctcgtaccgatagccgcgaaatctatcgcaagcggcgaaccccgccctttagacgaggacgtggcatgtgggtcgtgccgggtcatcggtccagtgaccggccacgccaatcggcagtactggtgaggtttggcggtcagcccggatgtcctacgccgtacgggcataacctgctggtaggacagcatcgctcgcgaggaatctccgcggttgcggttgaaccagtggctgaagtgggccactgaaagttcataccagcaacgggcaggcaatctcgctgccggtcatagcggctggatgcctgagtatcggcgccgcggagcgctgccgccatcatgaagatcgcgcacatactccgcccgcctaggagcagcccctcagcctaaactgccctacacgggccccgtgctcttgctgctgcgcggggcccggcatcttcacgatgccgccagcatcaccccagcggcacccccgcgctcggcttgacgggcgacatgtgactaggtactgttatcacgtacgccccagtctcgcctctgccatgtgcatgccgctggggctccttttttgcccaaaagatcgagcaagctgactcgatcgggttctttccccgccctcgcacccacacaagccgccaagcctactaccgttgttcaggtggtgggccatcaacatgccgcagcaatcccgcagtggatctccccggaccggttcgagccatacctgcgccacgccggccacgaccgcgacaaagcgtgcgaactctacgaatgggccgcagagctcaactccgccgcgttccaggccatccactacgtcgaggtcatcctgcggaacgccatcgacctgcagctgcagaaacgccgcaatgaagatgccgccaagattccctggttcctgaccccgctaggcagcgacaacaaaagccagcaagagatcgactacgcggtagcgcaagtccgagaacgactccgcaaggtagacaagcgcaaagacacccgcgcccagatcgtcgccggcctgaccttcggattctgggccaacctgctgcagacccgccacgaagacctctggcgctcaacgatccgccacgccttcccgcgctcctccggcaaccgctccgacgtcgcacccatcgtgttcaagctgcgcaccttccgcaaccggctcgcccaccacgattccctgctcgccgtcgacgtgccgttccagatcaaccaaatgatcaccctgctcgattggatcgacgaagacgccgcccactggctgcgctccaccgaaaaggccaccgcggtgcacgcccaacgaccgttcgcccgcaacgacaccgtggtcgtcgccggcgccgacgcttggccgctctaccagaaagtccacgcctacgtctgccagcccggccgtgccttccaacctgtcgaacacctcgccttctatacggcccgagccatccagccagaaatccccgtcatccgcgagcgcatcgacaacgtcgactggaccaccgccgagagccgccgacggcgcgccaccggcgaccccaaagaccagcgcctcgccgacatcatcgaccaaagcatcgccgacggctggaccggcggccgataccaagtcttcctgctctccgcccccggcgacacaggccaccacacccgccgatcgaccatcccccacactgccccgcccggccgtgggcaggcctacacccaaggccagcgctacgcagtccggcaaaagctgatcagcgcccgcaccaccagcgacctcacctagtactccagcaggagaacattctgagttgctgtgccggccggcttgaccaaactccggtaacgcgctcgcctagctcgatcttgcacccagtcgatccatgtggctaaatctgtctacctctcgtgaaagaagagtcagacatgcctcgacggtcccctcggctgtggttgctcaccataaccaccgctgccgtttccctgctggccagccttccggctgccgtctccgtgcaggcagccgcagctaccgcgtacggccaggatgtctccgactatcaaggcaacgtcaactgggccgcacagtggaacgccggctcgcgctttgcctacatcaaggccagcgaaggcaactactacgccgcttcctacttcgccagccagtacaacggcgcctacaaccaaggcatgatccgcggcgcctaccacttcgccatcccgaacgcctccagcggcatcagccaggccgattacttcatcgcacacggcggcggctggtcaaaagacggccggaccctgcccggagcgctggacatcgaatacaacccatacggcgccacctgttacggcctgtcccaagccagcatgcgcacctggatcacgaagttcctgaaccgctaccacgatcggaccggccgctgggccgtcatctacaccaccaccgactggtggagcacctgcaccggcaactacaacgggttctgggcgaactcgccgctctggctcgcccattacgcgagcacaccgggaacgctgccggccggcgcatcgacgtggtcgttctggcagtactcggacagcggcccgttcgccggcgactcgaaccaatggaacggcagcctcgaccggctcagggccctcgcctgcaacggctcctgctgagcagacgacttggggttgtattcaatggcgttggacagcaggtgatcgatgatctgccggaggcggtgcgggtcggcttcgactagcagcgtggggggcatgtcggtgtggatgcgtcgttgggcgtcgacgggcacggcggcgaccgcggcgttgacgattcggcggcaggctggaactgaaccagaaatttctcatggatgctgatcgcatcagcggcttaccgatgagggaagctattcctatccacggttgaagtcgtccggggtttcgacggccttcgctctgaacgccttgcccagcagatcaggtccgccgtcgacgagggcgtagaagtcgacgtcggccggcaccgagtcgtgggattcactgtttagggcctcatcgagcaaggtggcagcctcggccatcccgaagtagcgcagggcgatgatcgcgcgcctgacgcgggacggctcgttggcctccagggcgaagtacaggccgccgcccatcgccgagttgtagacgcgcatcaggtgagtcaggtgctcgataccgggcggggtgccgtcgggcaccccgccctcgatgccgtagtcgttggcttcttcccagatgaggtcgaggtcgtccgggctgtcgcaaccatgggcgagcacctgggacagggtggcgaaggtgtcgcgtgcctcggcgttggccaattcggtcgtccatccctgcagccaggggtctgcaacggagagcagagcttcccgggtgtggccgaccaggtcttgcaggggcgaaatcagtcggatgttggggatgaggtcgagttcctcgagcctagcgagctcctcgtcgaactgctgcccgccgggcagagcagccgcgacgacggctgcaactgcgacgatctcgtccgggaagaactccctcccgaggaggtcggggttctccttgaccagcaagaaggtgcgtctgaggacggcctgccgctcggccggagggtggccggcgagctcgccgaggaaatccatggcgccgtcactagagaacggaccggcgccgaaagtgcccatggtccccgacggtacaagatcgtgcggaggggttgtggaggggcgggaccaacggcggaaatctattggaggatgacggagttcaacaaactcgatgtcgacatcaacgtagtcaggcgtcaggcggccaggcgatgagcagcgctttgtcagcgacaaaagagcgcgatcgccttccggccgctgccgcggtcaggggcgggcgtctgcccctgaccggccagcgtccagcagcggctggccgagacgatccgcggccggcagtacgaagaagtagccgccgccgactggcaacacgtaccgctcgagtggttcgccggcgagccggcgctgcacggcggcgaacccgcgctcgatgctgttctggtaacagatgaagagatggccctcgtcaggttggccggtggggtcaaggccccgccggaacgagtatccccggcgcaggatgccgccgccgggaggtccggcagtgcccggatcagcccggcggacgtgcgcgtcgagcggtgtccggccgagcggcgcgccgtcgctcttacgccgcccgatgatcaactcctgccgactgaccggatcatagttccaccgggcgagtgccagccggattgtgcgcaccaccaggtatgtacccccggccgcccacgcgtctccggcaccgaccggccgcacccagagccgatcgtccccctcggggttgcccgcaccctccgaaaagccgaacaggttgcggctggtcggccggccgtgcgcgtcggtgccgttcccggcccggaatccggtaatccgccaccggagccggatatccggtgtcagtagtgaccgcagagcccgctgggccgtaccgggcaggtccgcgccgacctgcagcagcagatctccatggcattgcgctggatcaagcaggtcgttgcggaaggcaggcattggcacgagctcgggtgggcgtgccgtagccaagccgaacctggcgtcgaacagcgacgcgccgacgctcaccgtcgtctccacctgcccgccgagggcacgaatgccccggtccagcatcgcgaacaggcgcgtcacgacgtcgagcccggcaccgcgtaggtcaagggcggccagcacggtggcgttcgggggcaggctgacgatgccgggctgatgccgcggggcgccggtggtgcggaatttcgccgccgcggcgacgggccatgcgaggaccgcgcggcgggtgacttctcccatctgatctacacctccatcggcgagttgaaactgtccgccgccggcggcatgatcaggaacgggaagggattcaggagttcggtccagtcgcgttcgtcgaggtagccgttcccatcgacatctacgatcgacataaaaatgcccttgagtgacgtgtcgtagaagacgtgaccgccgggcaggtgacggcctcgctcatccagaccgtggtagtgattggctccggtgccatgcgcttcgcgatggcatgcccgaccgccgccaccggcggccgtactaacgtctttggccagctttcgcgcgcccttggcgctgttggtggcaacatgcagaccggcttggtagaggcgcatagcctcggccctcgccacctcgcggatgactcggaaccccgcgccgctgacgagcgcgacctccttccacaccatgccggtcgggtccgctcggctgatgggctctccagctgcgtaggcgtagagactcccgcctgtgccggccgggtcctcgctgatgaatctgccgatggcgggcgagtagtaccgggctcggtagtagtagaggccggtgccgtcgttctcccggccggtgtactggtagcggttggtgctcggcgtgccggtcgtggtggtggcaccgtacggttcgtagctgtagcgggtggcgatgccgttggcgtcggtcagagcgacggtgctgccgagcgcgtcggtgaggtggtatgtggcggtgttgccctcgatgcgtccgaagtggtcgtccaggtcgagtccgccgaggagcgtggcggtcggtcgtgcagtggtctgctcctggacggcgttttttccgtcgtacaagtagttgctggtgacggcgccgaccgtgacgctggtgcgccgaccgaactggtcatagcggaaggcggcgttgccgacggccgtgagctggtcgcggtcgttccagcggtagttgcgggtgccgtcggaggtgaggttgccgttgctgtcgtaggccagggcggcgttgccccaccgagtgagacgatctgcggcgtcgtaggtggcgccggtgacggcgggtggtaggtcgacctgggtcaggctgccgtcgacgccctggcgacgccccgctgtgtcgtagcggtaggtgatgccgccgagcgtggcggtgccgcgccggtagtcgacggcggtcgcctgaccggtcgtgtcgtacgcgtaactggtggtgaccccgtccggcaggctgaccgaggtgcgtcggccggcggtgtcccagcccagccgcaccgccgcaccgccgcgggtgacgctggtcagccggtcggcggcgtcgtaggcgtagccgacggcgggctggccctgcaccgtcatgccggtgcgacggtcggcgctgtcgtagctgtagtcgacgcgcccctgtggtgtctgctcggtgaccagccggtcgagcgggtcgtaggcacggctgatgacgccggcggcggtggccggggcggtgctgacttgcaggagccggtcgccagcgtcgtaggcgtaggtgtcgacaccgctgccgccgtgcgccacggcggtgggccggtccagggcgtcgaaggtgacggtgctggtgacgccgcgccggtcggtgtaaccggtgaggttgtcgccgcggtcgtaggtgtagcgctcggtcttggccagcgggtcggtgcggctcgccacccgtcccttggcgtcgtaggaccaccgggtgacgccgccgcgcgggccggtcagggacaccaggttgccgccgggatcgtaggccatccggctcaccccgccgtgagcgtcggtgacctgcacgatccggtcgagcggatcgtaggtgcgggtctgcacggcgccgacggcgtcggtaacgaagacggggcgacctcccggatccacccactggccgccggtacggccgagcgggtcggtgacggtcgccagcaggcccgcccggtaggtcaggcgcgtcgtggcgttcaccgggtcggtgacctcggtcggccggcccgcggcgtcggagcggaacgtggtccggtcgccggccgcgtccgtgaccgagctcagggcgccgcggtcgtcgtaggccaaggcggtggcccggccgagtggatcgaccacggaagtgatctgcccgaaccggggttcgtaggagaagcgccaggtcacctgcccggacgtgccggccaaccgggtcaccgaggtgaggttgccgcggtcgtcgtaggtgtagccagtccgtcggttcaacgggtcgaccacgccgatgacgcggttggcggcatcccggcttagagtcacgcttcggccgaccggcgtgcccgcagcacgagtttccacggtggcgtaaccggccgcgttgaacgtcgtgctccgctgcacgccgcgagggtcggtggccacagtccgggtgatccggccgccagccccggtctcgtacgcaaatcgccaggttccgccgtcggccagggtctgggtggcgacccggccgtggctgtcgtaggtgttgcgaaccttgacgatgcccgccggggtggtgaccgatagcatgcggtgggcgctgtcgtacgtgtaggcggtgatcccaccggtcggatcagtcacctgtgtcaggcgtcccgccgtgtcgtacgcgtaccggacggtgcggccgagattgtcgcgggcctgcgtgattcgaccgttggtgtcgtcggcgaagctgatccaccggccgctcggcgacgtgacctgggtgatccgaccgtcgccgtcccgggtgatcgtgatccggttgccgaaccggtcgcgtaccgccgccagcggccggtactgcgggaactccagcaccgtgccatcgcgcagtgtcagcagccagccgcccgcggcgccccaactgatccgcgaacggtagaactcgccggggctgccggtgtgttcgaacacggcgtcggaccagcccgtgcccgccgaggtgcgcacgtagtggacccggccgccgtctggcagcaccaggtcgacctggcggtactgctcggccgaccacaggaacatgtcgtaggtcagcgtggtgccgatgccgaacgcccgggaccttgggtcgccgggccgatacgtgcgttccaggccgatcggcagcacgtcgtcgaggcgcaggtcggtctctgagtgcaggaagaggccggtggcgcagtccaccgggtcgccggcctggctgcagccacccggcgggggcccgacgtccggcggcaggttgccggcgttgaacatggcgccggtgaactcgtacacgccgacgccgggcgcgggctccacctgccgccggtccggtgacacctggccgtggccgtagacgtgccagccgcggccgcccggttcatagctccagaactcgactttctggcgcgccggcagccggctgtggttggggtagatgatgcgggcgccgcgcggccacaggtaggccccaccgggctgcaccgtgaagtagacgggcgcgtggacgcccaggtgcggcagcgggaacggtggccggtggggcgggatcgcggtgatgccgagccggcgtaccaccgcgccgttctcgtcccggatcacggtgccggccgggatgtgcacctccaggccaggcaccttcgggttggtcagtacgacttcgcgggtcgtgggcgacgcgacgcggacttcgtgggcggtgtccagttcaggcatccagacggtgaacggcagcacgttggcggtgtccgccaccaggtccaccgtcgcttcgaacacgccgtaccggcggccggcacggttggcggcgtggccgtcgatgtgcagcttatgccgcccggacggcaggccggtgatggtgaagtttccggctggatcagcgaccgcggcccgattaccgacccgcagcgtcaccttggccaggccggcgccgttcagccgggctaccctgcccgtcagcgacgtggtcggcgcggccagccgggggcgctccgccggacgcgctccgccggacgctgccgtcagcgccacctgcagggtgccggtgtgctggtcgcgaggatcgacgacgatcgtgtaggtgccggctgtgggcaacgtcaggggatcgggggtgagctcgtttctagctagctagtcgctgacccgcatagccggcgaggacaaccatcgcgatcttctctggtttcgacacccggaccgtggtggcggctcccgtggccagcgacgtggtgaagtcgacgtcagccaccccgaacgatgacggcggcacgtacgcgtatcccgaactgcgtgtctgcccgaagggggtagacacgccgatcggcccagaggtgacgcccgccggcgcccgaacagtcagcgtgctcgctgtggcagcgaccacctcgccgagctggccgttgaagtcgaccgcgttctctgcgaggcggggtgagaagttgccaccctcgatccgcacggtcgatccggccgcgacggtcactggactgatgccggtgaccgctggtccaggcggtggaaaccggaacggctgggcgctggtgtacgcaccggtcggcgtggccacccggatcgggcccgacgtcccgtcgctgggcacccgaactaccagccgggtcgtggaggcggacaacacggcggcgggagcggagccgaactgcactgagttctgtgccgccgtcgcggcgaagccgcggcccaggatggtcacgtcggtgccggcccggcccaggcgcgggtcaaaatcgataaccccggccgtggtggggttctcccgccggacggcggtgatgttgccggccgtgtcgtactcgtatcgggctacgccgtcggcgccaccggcgcctctgacaacggtaacgaggcggccgagctcgtcgtagacgaagtccgcgccgctgcccacagcgcgggccgtcgccggtaacgcgtcgacaatcacggcagacggtgccagcagtgcaacgatgatcagatatatgaacgctgaaccgaagccatgcttacctcgaaagccccagataaccatactaggaacttaaggcatctacttgttcaaagcgggaaaagctcgcggtctagcatctgggccgggcgatcccgctgtgcgagcaggcgttggccatcgacgctgggtgctcggcgaccaccaccctgacacgctaagctcggtgaacaaccttgccggcgcctacgagacggtcggggatctggggcgggcgattccgcgatacgagcaacacgcgcaccgccaccaaccgcgactcacggtggctatttcccggccgccgcgccggccaaccgctccaggcgcgcaccccgtcgccactgatccccgaacttggcgtcccgaccaccagcggccgcaccgccgcaatccgccagcacgtccttgacctgccagccccgatcgtcgtggaatccttgaggcgtgacgggccgagttcagcgggtaggcgtctgttgtgacggttgccgctgctgagaggttggcagtgggcacgacctgccggggatgggcacggcgttcgttgtggtggcggcctgacaagggggatcactgtggtgcgggagcacggcgacgtccagccgggcgcgcaggcggccggtgacggcggtgtcacggtctcccatgctcagggtctgcaagtaggtgatcgcaacgtccagcacaaccatttccctgccgccgctgtgtcgccggtgtcggtgcggccggctgcggtgccggcgccggacgggttggtcaacgtggcggtggcgccgggtgtgttcgtcggccgtggcacgcagctccgccagctcgatgaggtgctggccgagccgggggccgcggtggttcaggctgtccacgggttgggtggggtcggtaagagcacactggcggcacagtgggcgtggcagcaccgtgaccggtaccggccggtgtggtggatcgacgcggacacgacagccggtatcgacgccgggttggccacgttggcgaccgctttgcagaccgacctgcccgatggcctatcgctggaggtgctgcgggaacgggcgctgcagtggctcgcctcgcacgacgggtggctgctggtcctggacaacgtcaacgacccgggcgatgtcgcccgcttgtcggctcgtgtcggcaccggccgggtgctggtcaccagccggcgggccaccggctgggcgggcattgccaccgcgatcgcgttggatgtgctcgacctcgatgacgctgtcgaggcgatgcggcaggtcttggccggcagtggccgtgaccgcgacgccgacgggctggtgcaagtggcccgggagctgggctgtctgccgctggcggtggaccaggccgcggcatacctcgccgaaacaggcctgtccagctccgcctaccttcagctgttgaagcaatatcccgccaacatgttcgcccacggcggtgaaggtgccggtgagcgcaccatcgcccgggtctggcgggtcaccctcgaccggctcgctgacacacctctggcgggcaagattctgcgggtcgtggcctggtacgccccagacgccatttatcgtgccctgcttgccggattggctgacccgccgacgatcgcccgggcgctcggccgactcgccgcctacagcatgatcactctcgacgagcacacgctgactgtgcatcggctggttcaggcggtcgctcgtactccggatcctgaggacccgcaccggcagcctgatgacatcgacaccgcccgtacccaggcgatcgctgagttgcgggcggctatgcccgatgactggcgcctgccgaagcattggcctcgctggcgtgcattggtgtcccaagtagaagccctcgccgagcacagcagcaatcgcatcgacaacgacaccgcggccagttcgctctacaaccaagcagcagtatttctccacgaccaaggcgtcgtagctcgaaccatcccgctgtttaagcaggcgctctcggatcggcgtcggttgctcagtgatgaccaccccgacactctgacctcggtgaacaacttagccagcgcctataaggcggcgggggacttaggccgcgctattccgctgtttaagcaggcgctctcggatcggcgtcggttgctcggtgacgaccacccaggcactctgaccttgatgctcaacctcgccggcgcctacgaacaggcgggtgatgtgggccgagctgtgccgctgcttgagcggacactcagcgcctacaagcggatactcggagatgatcacgcggacactctgaacgcgatgaatggtcttgcctcggcctgcgcctcaacgggtgatctgggccgggctgttccgttgttcgagcagtcgcttaccgactgccgtcgagtgctcggcgaggaccacccgcaaactctgattgtggcgagcaaccttgcctccgcctatacctcagcgggtgatgtaggcccggctgttccgtcctgcgagcagtcgctcaccgactgccgtcgtgtatttggcgacgatcacccgcaaactctaagcgcggtccgcagtctggcccatgcttacgaggttgcgggtgatgtagcccgagctattccgttgctcgagcagtcgctcaccgactaccgtcgaacactcggcgacgaccacccagataccttgagcgcggtgaatagccttgccttcgcctgggcttcggcgggtgatgtgggccgtgctgttccgttgttcgagcagtcgctcaccgactgccgtcgagtgctcggcgacgaccacccgcataccctgaccttgatgaacaaccttgccagcgcctacgagcatgccggtgatgtgggccgggctattcccttgttcgagcagtcgctgacgggacgtcgtcgagtgctcggcgaccgccatccggacacactggcatcgatgaacaaccttgccaacgcctacgagcaggccggtgatatgggtcgggctgttcctttgttcgaacaggcgttcacgggacgtcgtcgagtgctcggcgaccaccatcccgatactgtgctttcgttgaacaaccttgccaccgcgtactggacggtgggtgatgtggacaaggcggttccgttgctcgagcagtcgatcacctactgccgtcgggtctttggtgacgatgcccccggtaccgtgctctcattgaataatctcgcctttgcataccgagcgagaggcgacgtgagccgtgctgttcccttgttcgaacaggcgcttgctggctgccggcgcgtctttggcgacgatgatcctcgcaccaagctcgtggaggagagtctgacgctgctttgtggcagcaacgaatagcgttccacttccatggttgtggaacgcgggtagacgcgtaggaagccccgcatctgccggggcttcctgcatcgtcggtgccggggtgtggctgtcagccgatggaccaggagccgtccggcgcagcacctgcacgcattggccgagggggccggtgatgctgcgggcgaaccacaccccgatcgccacgctcagcagcagcacgccggcgacagcgctgagcacgatggcccggacccggtggtaggtgtcctggctgtcctggtgctgggcggcggcgtcggcgacggtggacttggccatcttcgtcagcgcgtcgcggatcgccgctttcggctggggttgccggcacctggagggcggcaagcttgtcttggctgcgttgcgctgaacctctttcggcgaaccgatcaggccaggtggagggctcgccgcgcccatccgaggtggcgcgagcggcctgtagggtgccgtgtgctggttgtagccgagaccggccaggtgttatcccgaggcgatgagtcatcgtcgttgaaggactgcagcccgtaccccgtacgcgcgggaactcgctggcctgctggaaatcctctacgacagcgccgtaccgaaaaccaaccgacacagcggcggtgagcagactatgaccatgcaacggcttccaagacggcaccgctcggggccccgctctctcgaccgccagggccaacagtgaacatcatcgtcagtacggacgccggcactgtgtatctgaacgtggccggtgaactggacatggacacggctgacgacctgcataaacctctgcaccaagcggtcactcggcccggcaccaccacgatcgtgatcgacttcgcccaggtcagcttctgcgactcctccggtatcgcagtcctcgaccgcgcctacggtgaggcccgggatgcaggcatcaccctgcgactggtgaacccgcagccgacagtccgccgggtcctgagcctgctccgcatgttgcagaccctcaccggcgcggattgacctcgtagggggatcgtcgcagccgtcgagtaggcatatggtgctacgaacggcgacgctccagcctcctggctatggccgtcatgcgccgtcgcgaccacctcaccggctacgagctgaccgtgctcggctcgctgacggaccccgttgaggcgctcagcgcaaagatcacctgcgaattggccgccggtcacgacgaacagcacacggcattcctcatcgccacccagcacggcgaccactggtggatccgctgggacgccggtcagcgcgcgctgaccctcgcggacttctgcgaccaccacaaccagcagagcgacgacgactgcctgcttcccaaagcgcaccccggccgatacagcttcgagttcgagtcgtagcgagttcaccgcttggtctactccattcctctgactcttccggtgccggatgtttcggcaccggaggactcatgtccttgccgagtcgagccgatgggctcggtgtgaacgcagtcgaggtccggaccctcccggtcgagttgttgatcagtgatgtggggcgccggatgacggcgcaggcccttgccgctttggaggagctgggtctcagcgagggcggctggtgggtgctcagcgcgctggcggcggccgcggacgggctgtcgctggtcgatgtggtgcagcggacggcgttgagctcgtcgacggttaccacggtcaccgagcagctcgccgagcgtggctggatcgagcgccggcgtgctgtcgatgatcgcaggcgggtcctggtggctatcacaccggccgggtgcgccttgctggatgccgggcgggctcgatgtgagcaggtgttcgcggcacatcatgacgtgttcagcgatggggagtggcagcagctcgccaccctgctgggccggctgcacgccgtcgcgagcacagccgtgccgcaggcgggtgaccgggcagtcgatgccggcgcccgagcggcggtggcagcacagcatcgcgacggcgttgctggtccgcgtcggggtggcgatgttcctgccgatcagcatcgccacggtgtggctgctgatcgacccgcagggccggcaactgctgcagatcgacctgtcgcggcgcatgttgtacgtgatggcgctgctgctgacgctgctgttcgccgaggccgtcatcgacatgcggcgccggttcgcgcgggtgcgcaccctgctggcggcgatggagtcgctggccgccggtgacgtcgacgtgcgcgtcgacgaccggggccgtgacgagatcacgctggccgcggcgtgcgtcaaccggggcgcgaaaggcctcgccatgctgctgggccaggtggccgatcacgcccgggagttgcatgccgccagcgatgggctgtcggagcacgcgggggcggtgacccggcacaccgccgagaccgcgcagcaggcgatgctgctgtcgcagtccatcggcgaggtcaacaccaccctgcaccagctgcgcgacggcgccggcgaagtgcgttccagcatcgacgcgatcgccgcccgggccgccaccgccgggcaggccgccaccgacggagtgacggccgcggcgaccacccgcgacagcgtgacccggctggaaacctccagcacccagatcagcggcgtcgtcgcgttcatcaacagcgtcgccgcgcaaaccaacctgctggccctcaacgccaccatcgaagccgcccgcgccggcgacgcgggtaaggggttcgcggtggtggccggtgaggtgaagggcttggcgcagcagaccgagcaggccaccggcagcatcgacgcccaagtcgacgcgatccgcgaggacgccgcggccaccgtcaccgcgttgcagggcatcgccggtgccatcgcgcagatcaacaccgagcaggaatacatcggcgcggccgtcgacgcgcaacgggccagcaccaccgcgatgacccaacgcgtcaacgacaccgccgacaccgcgctcgcgctgaccgccaccatcaccgacctcgcgcacaccgccagccgatcgaccgaaggcacccgcgaagtcgccgacgagatcgccaccctggcctgcatcgccgccggcctcgaccagctcaccgcccgctacagcaccagtacgcctcgaacgcagcccgtcccggcggccccgcgcaccgcgcggcccgccccggtcgagcaagccgcgatcgaactgttctgacctggcctgccagccagcaccgtcctgccgacacacctcccgagaccagcacaaggagcccgccaccgtgcccaccgtccccggctacgacctcgaccagcccacccaggcgtccctgaccgccgccctcagcgcccaactcgggcccgaaaccgcccgcgcgctggtcgacctcaccgccaagaaactgcgcctgacccgatccggcaccaccgacgacctggtccgcctcaccgaggaactcatgaccatcggcgacgtcctgcgcgtaaccgcccgctccgagaaaatccgggccgtcacctaccgcgccctgcaccagaacgtctgagccgccagcatgcgcgccctcaccacgtcggtacccgccccgtgccagcagcctcggagaaactgatgatcaacaaccagcagtccaccacactggccgcccctgaacgcatgcgcgtgctggccagcatcgacttcgacaacctcgacctacggacggcgctcaaccggatcaccgcgcgcaccgccgaacgcaccggcctgccgatcagcctggccaccctggtgttcaacacctcccagatgaccgtcggcgccaccggcctcgacgacacctggatcgccgccgcggacggcaccccggtggaatggtccttctgcgccaacatgatcaccaccggccggccgtacgtcatccccgatgcccaccactccgaacaagccaccaaccccctggtcaccatcgacggcatcggcagctacgccggtgtgcccctgaccgtcggcggccagatcgtcggcgcccactgcattctcggcacccaggctcaccagttcactcccgagcagctggcggaactggcctgcgctgcgcaggaaatcaccgcgctgctgcaggagttcagcgacctggactgacaccctgagccactgggctaccgccgatacgcgagctgctgtaacgccaccctggccgctggcattcaaccctgcacggtggagtggcacgaccacccacccgggccaggaaccccggtatctgaaggcttataccggcaacgccgacgccgatgagtaagccacctacccgccctccgcctgccgctcaacagcccggccaaggagcacaatgcaactcgtccacgccggcggctggcggctgctgcagatccccgacatcaccgacccgggcctgtgctaccggctgtgccgcgaccggatctgggccggcgactgccacaccaccgaactgcacgaccgcctggccttgctcggcctgagcctggacgacttcaccaccgccggcatcgactgctgcatcatggtcgaccccagctcccacatcgcctgcctgcgtcccgccgaacccgtcgacggacaagcccacctgcccttgtgcagcctgtgccggcacaacctgacccagatgcgcggcttcccccgccaccgcgacatccaccagccggcagccgccataccgcacctgagcaccctgtggcagcatctggacaccgaccacgatcggcgggaactgtcccaccacctgcgccatcccatcgccaagatcctcggctgggccgaagtcctgcacgacgacaccaccatgcgccccgcccaggcacaccagatcaacgtcatctaccaatcagcctgcgacctgcagcaactgctcgacaacgcagcctcaccgctctaactgccaggcacaaggcgccaccctgggccctgaccgtgccggccgacgacgaatcaccagcggcgagcagcagttgtgtgacgcacagaccgcgtagccggaccgaaaaccagtcgggctcacagctgcccaggttggcaggccgacgcgacgcgtcgggtgatcactcgacctcgccgacgtccggatcacgcagcgcctgataggcacgtccttacccgctccaagatcaccgctagcgccagttctcgttgcaatgctcctcaagggctttgtccgttccacttccttagaagtggaacggcgaatcatggaagtcgctcaagcggccgcagccggtccctccggcaccagaaggtcacaattgctactggggtcgtcttggatgcgccagccagatggccaggtgtccttccggtttgcgcgccgcatcactcgcgcgccggccagggacaggctgctgccgggttccaagatcgctttgccgagctcggcatcaccggtgaacgtcgcctcatcgaaccacgcgaagccggtgaaggtcgccccgacgaaccaggcgccgtcggtgaacgtcttgcggcgtgcgataggtcttcgtcgacatgatgaccgaagatgcgcagtgatcgatgcctggttgaggatggggtatgcggcttcgtgaagcggaaaagattcggcaggacgctctcgaactgatcgacagtgcgaacaagtgcagcaacgtcggtgatgcggcggtgctggcgcagcaggcgtcagcgatggcaacgctggctgttgccgccgaactcggcgacctccgcgacagtgttctcggcgtcaagtccgcgctcggagatcaggacgggtatggggcggccgggcatctgcggttcatcagcgactggttggggagaagatcgccgaccgacctcggtaagagggcaggcggccttgaggcctgtggttccgatggtgcaagcgcggtggcgcccggccggtgggtggatatgacatccagagatccatggcttccgccggcttgggcgtcccgccagcatcaacgatcggccgcctacagcagcagctgagcgggtggcggctccgggccgagagacatgtcgtcacgccacttccccgcccgctggatcgtccggacgcggtgcgcggtgccgctgctcgttcagctgcccaccaccgccttaaagggccatgtccacgaaccgggacaggtgtagttgcgccgccacggtgatcgtgtctgtcggcccgttccgatgcttggccacgatgaaatccgcctcgccggcccgcgcggactctttgtcgtagtagtcgtcgcggtgcagcaggatcaccacatcggcgtcctgctcgatcgacccggactcgcgcaggtcggacagttgggggcgtttgtcctgccgctgctccgggccgcggttcagctgagagatcacgatgatcgggcagccgatctccttgctcagcagcttcaggccgcgggacagctcagaaacttcctgctgccggctttccgtcttcttcggcgacgacatcaactgcaggtagtcgatcaccagtagccgcaggttgtgcttcttcttcaagctgcgcgccttcgaccggatctccgacatgcccatgctcggcgtgtcatccacaaaaatcggtgcgtcggcgatctgacccatgcagcgagccatccgcgcccagtcatcgtcggacaactgcccggaccgcagcacgtgcaggggcacccgcgcttcggccgacagtagccgggtcaccatctccaccttcgacatctccaaggtgaaaaacccggacggcatccctgcccggatcgcagcatgccgggcaatgtcgaggccgaccgtggatttaccgagccctggtcggccggccacgatgatgacctggcctggttgcagtccgttcagtagccggtcgaggtctttgaacccggtcgggactcccagcatcgacccgtcgcggctgcccgccgactcgatgtcatccatgaccggctggaacacgtcaccgacctgtgccgtctctccggcgccgcggtcaatggtgatgtcgtagacggcctgctgcgccagatcaacaacggcgccaagttcgaggccgtcaccgttggccgagccgtagccgagctgtgcgatccgtatcccggcttcgaccaagcgccgtgacacggcccgccgctgcacgatccgcgcgtagtagccggcattcgccgccgtcggcacggcttcgatgcaggtgtgcaggtacgggaccccgccgagccggaccaggtcattggactcctagctagctaggggcggcggccacggtgagcgcgtcagccggttcccctttaccgtgcagcgtcaggatcgtctcgaacacggtgcgatgaaccggccggtagaagtcagtaccggtgatgatctcggtgacttcgtcgactgccgcagccgacagcagcatgccgcccagaacggcctgctccgcctcaacgtcgtgtgggggcaccctgtcactcaccggacacctccgaggcgtcagcgtcccagttagggcccgcagtgagcgccctcaactggtccatggccgataccgaaggcggtgactgcgcttcgaggtgatggccgaccgccgccagcacctcccgcacatgcgccccgccggcctgcatacgcacctgccggttcatgtcgtcctcaaacttcgacggcaactgcagcgcctccgacggctccaaacggcgccgctccgcacggatcgccttcacgccggcccggacgtgcgcgggcatcaaccggtcggtctgatcccggtaatgccgtaccaccgcggctttcgcgtcgtccaagtcgatgtcgtcgagcgccaggtaccaggcttcgacgtcggcctcaccgatgcgccggtagtcgaaggtggctgccagggtcagcagcagcaccacctcggccttatccatgctgagcctcctcaagcttgcggtacctctgatacaggtcttggttgtcggcaacccgctgatctgcgggggagcgcggaatgggggcgcgacgagcaagttcggagcttccgcggccttgaaggtcgtgggcagctgcgttcctcggctgggcgtcccccatgtccatctcgtcgttccatcgttcaccggaaagccacccgtcgggatgcttggttttgtccctggggatgccttcacgtcggacgcggtctcgataggactcggcgccggcgatgatgtcctccggcttggcgcccttttggacggctgcggcgtaacgggtgcgtgcttccttctttgacaccttgagcgggtaggcgtcccaaaacttgcaccagttggggtcatcgtcggcgccgggcgccggtgtcctcaccggcggaggcggtgggggtagtagttctccctgttcctcttttccctgttccttcttccctattccgggcgcgagtgtttcgcgaggctctcgcgagggtgtcgcgaatgctgtctccggctcgtcagcctgcccagcgttttcgctgctcagatgctgtgcgccgggatcctcgggtccggggtagcgcgccttgcctggcctgtcgatcttttgatgctcgttccagttgacaacggccaggtaacgcttgccgttgacggtgtaacgaactatccgaccggctgcgtgaagcctcgcgagatcctcgcgaacgttgttacgggcctcgcgaggatcctcctcaaggccgaaaagttcggcggcgatcaacttaaagttgtcgagtccaacgccgttgtcgtcaacgtaggtccacagtccgataaaaaacagacgtgcccgaaatgggagaacggcaatgctctcagacttccaaaaatccggcttgaccgttcggatgcgtggcattagacctgtacctgcttccggctacggcccggccgtggctgattgaaagatttggcgagtaggtagctcaggtgtcgaagtacgtcgaccattttgtcttcccagggcgcctctggttctcccgcgcaggaccagtcgcgctccgccgcttcggttgcggctgccagcatgccggcaggtactgcatcgaagacgtaccgggcaatcaagcgaagccgggcagtgtcatcagcaacccgctcgacaagtgaaagcgcagtgaggaccacagcgttgtcgtctggataagtccgctccggcaccggaagttccagatgcgctgcggcgaacttcgccgcatcaagaaggcgctggtcttcgcccaggactcctcgtacctcgtcgatgaccataacggcaagatcatcgcgcccttgccaccacttatcttcatgatggctacgacaagcggtcgtgcatctatctccacagggtgactggctgcctagtgttgcggcagaagcttccatgaagacgttgtgctggtcattttccagcggcttctctgctttgatcgcttcccgctcggcgtctagggctgcgcgccggctgtcgtagtagtcgacctgggtggcgctgcggtcgacacgtacccaccagtctttttctttggcgtgggttgccatgcggtcggcgaagtcgacggtgatgccgacgtagagcaggacgccggtgcggtcgtagaaccggtagaggatgtggggccggttttcgagctcggcgcggccgacggagatgcgtgccatcaggcaatcaccgccacggtctggatggtgacagcggcggctgcgtgtgtgtggtgcgtgacgtacgatggggttctaggcttcaacacagcctgaacctcccttccgttgtctgagaacagaagcgtgaggagcgggttagcgcggtcatcggtggtaggacactgttggccgcgcgtctttttatcttagtcgaaccggcgttcgattccacgtttcggcccgcctcctttgtgcgattccagcccgacaatgatcaattaggtgagggtatctatgtcgccttgttgaactattagaacggaatcacgaaagacgtgtagctggctcggatgatgtgctctttgcccgcctgatcccacctcgcgacgtcaacacccggtagccgtccgcgaactcgatcagcgcactgttcatgccgccacgcaccagcactcgacagggctggctggcccggtccacgccgtcaccgaaccacggcacccgcacgcgaacacccgggtactcgaaggtgcgcgtcgaccacgcccagacgtacgggaagtcgcctactgctgcccgtgcatccatggcgtctccttccggtcgaacaccgagaccgggcacctgagcgtcgcggcgatgtcggtgagcaccttgcgcgacaagccccgagtacccttctcggcttcgcatagcagcgacgccgagattccgacagctttcgccaggtcagcttgtttccatccggcctgcttgcgcgcccacttgagagcggcatggtcgtgttccacccgggagattcggcgtggtcttgcggcgccgggtttggggatcagtcggtagtcgcgtttgatgatggcaaggatgtcgttgatgacggcttccagccacgcgtcgatcggggtagcgccgttgatgtccatgcgccgtttggcagcggcgatcagctcgtcggtcggttccatcaccgcggtcccactttgagggcctgtcccgcgagttccgcaatgccgtccatgccgggccgctccgaccgggccacggcgaacgcgcggatgtcttcgagtgcttgccgataccttccgatcccgccattcggcggctggtactgctcgtggagggtgagcgcctggccggcgtcggtaagccgtgcccggatgcttttctcgacgatgccgttgaggagtgtgacgaggccgcgatcggcgagctcgcgcagcggcttctgcacggtggtgtggagcggccacacctgctcgccgagccggtagcgggcggcaagtacatccaggatgagctgctgggtgggcggcaggttgtcgatgttgatgccgctcacccgctgaacctcatgttcagtggcccgtccggcatgatccggtcgggctcgtcggcgtgtggctgcagggtcaggatgggccgcggtgttgtcacgcggatgccgtgcttggtggcgtacgccgtgacgacgtcgatgttgtgggcggtgaactggcgaagggtaccgtcgtcgtcgcgccagatgagccgccagcggccttcgtgtttgtcgaggtatccggggatcgtcatgtcagttcccccgtcttgaacgctaggtagacggcgttggcggcgttgcgggcgccgagccgtgcgaggatcgccttgatgttggctttgatcgtggtgatgccgacacccatcagctttgccgtgtcggtgttggtgtggccggcggcgatgtagcgcagcgtttcttgttggcgtggggtgagcggccgggccgcggcgggcgcggtcactgggctagctccatcagcgcggccggaatgacaccgagaacgccgagagtgttgagggcatcggctgcggacgtcggttcgccgtcgtagcgggcggcgccgttgacgacggtcatgtccgggttggtactacctgcgtacgagccgacggtgatacgcgccccggtcggcagggtccactggtggcagatgtatgcagggctgtactgccggtatttggtgaccttgacgtcggctccgacggttctggcccagtgcatgacagcgccgattgcacgccagtcggggaagatggtcatgcagtcaccgtcaccggtgtgaacaggtctcggaattcggcatcgggcttgttggcccacagccggtcggtaagagtgtcgatccacgtgatcatcgggccacctcccagaaaacaccgccgggcgcagtgtcggtcaggtagcgcaggtagtgctcacgggccgggccgtctgggctgcagtgcgacgagttccaccactgcatgtacaggctttcgtctttgagggtggttagggccaagtcgtacccgcggcgagtagcctcacgaagcttggcgtgcagggccttgatctcctcttcctgcacgtgccgagccgccttcaagtgttcgaggaacagaccgcgtagttctggagggatgtcctcaatgtgctcgatcggctgggcctgatcggtcatgatgccgcctccggatcgtcgtattccgcgtcctgccagtcgccgctgtagccgctcgcggcccaccggtccatgcgctcagcgaccgcgctccagccggcttcctcgatcccgggggtgaagtggtcgctgcacacgttgggcacgcacttgttgcagccgccggcagcagcctggtccagggtggcgcgcacgagggtttcgtgcagggtctgagcggtcagcatcaggccacctcatcgtcgtggagaaagtccgggccgccgtgcgcggccagcagttgcagagcagcccggccgccattgtgtcggcgtacctgctgcaggaccttccgaccgaggctgatctgttcgcagttgccgacggtcagcaggttgatcagccgggatacgtcgtgggtgccttcggcgaccaggacgaccaccgggtcgccgtgctcattgtcgtatgcacgagagtcgtagctcaccgggctacctccgccgcacggctggggctgcggaagtggctggtctcgtatcgctcgttgaggtcggccgggttaatgcctgcccggtcgagaacggagacgatgtattcttcgatcctttcgccgttgagggcgtcgccgtccgggtcgtaatgccacagcaaggacggcaggtcacgaggggacgcgtcgaggccgagaaccgcggcgaccgaggtttggccgatgagcgccaggtagccgatctctgggcggtcgttcccggtcctcggctcgtgggtcacgtcgtagaagccggcaaacgcggccatggcctgcgcggcgtagtgccggatccactcctcgcgggtgccgtgctcgccgggcgtcgcggcgagctcgttggcacggttcaggcggtcgatcggggtcatcgcccggcctcctgagctgccacaattcgcgcgttctgctcgacgatctgcctcaggtggttcgtctttgactgggcgcgctcggcagtagcgccttcgggccacggattgcagtactcgatgtcgcaggaccagctcacggtgcgcgcctcggctaccgcccgccgggtctcgtccggcagtgctcgcatgaactcggccccacctccagcggtgatcgccgaccagtcgaccccagtcgccaccagagccttcccggccgaccggcagcactcgatgcagcccggcccgtcagaaacgtgcagtccggttgcccggtgggtgatgaggaagtctccgccgaggaccgcgcggaagtcttcggtcatgccgaaaacgggggtgatggcaaggtcgtcactgatcggctcgcagggcacagtcacgggcccgttcgaggtgacgacggtgcaggccggaaaggacgggatcttcgtggtcatcgggtttcctcccgggtgaggacgtcgagcatctgccgcgtggcagcaagctcagtggtgagatgctggatgtagctgatcagggcgggcacgtcgtcggtgaagtggaggcgtaccgctgcgggcacggccagcgactgccagtcagcccagcggtgggccttgtcgacgcggtcacggactgcatcgaggtccaagtcggtcatcggtcaacctccgcagtggccgagcaagagcacatgcccacgccgcagcactggccgtcgcagtcctcgttgcgtgaggcgggcccgtccatctcgcacaggcactcgcgcaggccgcggttgaggtggatcaccgcggctgcggcgtcgatcggggagaacatggagccgatccactcgttaccgcggtagatggccagcggctcgtgggggtcgacgtggtagcgaacagagatgctcatcgggccacctctgcgaagatctcgccgtgtagccgctccaactcggcatacacggcgtcgtcggtggtgccggccgcgacgatccggtccagggtgtcgcggatgaccgggttcgacagggcggacggctcgcagccgtcgtggaaccggcagccaccgtcgttggacggctggtgcatgtagatctcgttgaagcgggccttggtgctggactcaataacggtcaaggcgagcatgtgagggccgttagaaacccaccagtggaagaagccgccttcgccgccgtcgaacggctcggtggtgtggaaacgggtgagggtcactgggcctccttgtcgcggcggaacgcatctcgtgtgctggcgtcaggccacaacgcccgcaggattgcatctgcgtttggcgtgtagtcgctatcgagcagggcctgcacccggtggcggatcgcatcaacctcggcctgcgagtcggccaactgctcggtaagcgagtcgatcaggcgggtggcggtgtcgcgggtcaggctgaacgatgcggtgacgatctgagcgaccaggtcatcgtgatcggtctgagcggtcacgccgtacctgccgcgttgaggccggcaaccatggcctgaacctgcacccagcggatcttggcctcgtcgtactcgacgtcttcccataattcgatgacgtcgtcgccggagaagctgcgcggccagtcgaggagaccgccaccgagatcgacagggatggcagtgccccggcaaatgctgaagtcggcaccgtcttcgccgttgagagctgcgatgtcaggcaggggctccccgcgatagctgagaacggcctgccatgggccgcgaaggtggtcgttggtcatgaatgctcctccgtctgcggtattggatgccacctcagtgtggcctacagttggtggcatgacaagtcagctttcagtgccacccggtgttggccaccttcgtgtctgccagtatttgtctgtgacggacaaacagcttgccgacgtactcgccgcttaccgccgcgccgagaaggcgctcgacacccgccgggatgagctgttcaaggccatcggtgaagccgtcaccaccggtcgcgtccgccagtctgacgtggtaaagcagatgggctacacccgcgagcacgtccgccgcatctgccgggcgtacgaagactggcgagacggcaagaccaccgaactgaagcttgcgcggtagagcgtgaccctgacaacgctgcgtctgcccgtcgtgccgccgcgccctacgggctggcttgacccctgctgcatttaccgcttttacaacgacgcgggtgtgctgctctacgtcggcatcacgggaagcccgtcggttcgctttgaatcccaccgagccaactcggcatggtggggccaggctgacctgacgcggacgctggtctactggcgggagaccaaaggccacgctgaggccgaagagattgcggcgatcattgttaaacgcccggtcttcaacatcgcgcaccggccaggcccgcggatcactaaccggcagcctgcgtaccggggatgagtttgagtgaactcagagtccaactcggcagcagggtggaagcggcctttatgcgtggcgagtcgaccatcatcaggcatgggtcgaggaacatcgcgcgggccgtactggtgccgtacgaggtgggccccgaacccacgccagtaaccgtcagcggcgagacgcagtcgtacttggtttcgcccgaatggtttgagcgcgcccgggaggcgctgggcgagaagggtcacccgccgacctccggcacctgaccggcacccgcacacggctcgtcgctgctctccaccccgtcccgcgtgacctgccaccggccgtgcccgacgatcaacccgtcctcggtcgcaatgtcccaaccgcacaccgggcacaggccgtgctgcgcctcggccagaacgacgcacaacgggtgggcgccttccggggttgcggccggctgctgcgcgggcgcccaacctccacgccgacccgtgccgttgaacgaccgcccgcacaacatctgcggcaacccagtgcggcgcacacaccactcgtcccggtgctcgcccgtcgttgcccactcgaagccgtcagccagccggaccatcagtcgccgcccgtctccgggtccagcacccggatcgcccgcggcgtattaggcacccggctaatccacccggcgccctgcaaccggatcagctggtgggcgaccgcagacggggacaggtgcacaccggccccgatctccttcatggtgggcgggaactgtttctctgcagcgtaggactggatgaacgtgaggatccgctgctgcgtgccagacaacagaggcaccaccttggcgctcaccgcagcaccttacgagcggcagccgccaagctgacggcactcacaatgcgcttgccgaacggctcagcttccgggtcatccagcagggctacctgctccacaaatgctcgcagccgctgattctcggccagcgcatcgaagagccggcccgtcattgatcgggtatcgggcatagtcatgacgcctccacaggcacgggggacaggatgtgaccggccgcagcaagcgggttgaggttcagggcggcccgccgctgctccggctcgcgatgatttgcggagtacttgtggtagcccttggtgccgggcaggcactgcacctcatgcatcgcttcggcgagtgcctgcaccagctctgacgctctagtcatgatcaaaaaggtggctcgtcgtcgaacgaacgctgaccgcctgagcttgctgccgatcgagcgccctgcgttgcccacggatcaccgccaccgcgaggcgcttgctgcggccgtagtccgccgtcaccaccggaccgctgcgccttctgcaccttcaccgtcgcgtacctcagcgatggcccgatctcgtccacgtccagctcgacgacggtgcgcttctcgccgtccttctcatatgaccgctgcttcagccggccctgcacgattacccgggcgccgcgctgcagcgactcggcgacatgctcggcgggctcccgccacacgctgcaggacaggtacagtggctcaccgtcgcggtagtcctgcgtctgcttgtcaaaaacgcgtggggtagaagcaatgcggaacgagcagaccgcggcaccggactgcgtgtacctcagctccggatccgcgacgatgttgccaacaacggtgatcactgtttctccggccatcaggctggcatcctttcgtcggtgcgctcacgacagacgagggcaaggtcgtagcccagggcgtcagcccaagcgcggagggtgtcaaggcgggggctgtgcagcccggcctctgtgcggtagacgtactgctgcgacagcccagccaacccagccagaacgtatggcttgagaccgcgctggttccggcggtcgcgtagctgggcgatgatcgggtcaacggaagtcactggccaccaccggtaggccaggttcggaagttctgccacgatcgggacgctgtcggcccgcgctgccccatgtaacgcgagcccaacgacgccgtcccgtacggaacctcagccggggacgacagccgcggcgtacgtcgatgctggaaggctgcaccagggacgactcgaacggctccaagccgagctcaccagcccggatttcagctcgcaggtcacggtcggacagcagcattaggcagcctccgccttgaccgcacggaaccgaggctgcggctgaggcttgtgcgcctcacgccgcggcccgcccggatacgggcgcgtgtccgggcggccacacggcgccgtcacctcacccagcacagtgccggagttgcacgggccagccgacgggcgaatgggcttcactgcggcggtcatggctgcgcctcgcagccggcatgctgctccatgaacaaattccgatacgggccggagtcttctagcctgcgaaccgtcaccacgatctgatgccgagccgggcaccggaacgtccatgccgtcgtcgccgacatcagccggcgctcggtctcgaaaccgcccgtcggctgcccggtcaggtcgacgatcgtgaccacggccaggccaagcgggtactccttgcgcgacaccttttcgcccagcactggaaatggcccatccaggtgcgccgggttgtcgtccgggatcagcccgtacccgacatccaccctgatctcgccgttacgctgccgagaggtcttcgtcgggccgagcccatccgcaatcggtttgagtacgtacggatgccagttcgcgtcgtcgcggttcctagctaccgtgtgatgcaggcacacatcaatccggacccgctccagcccggtcggaagcttcgcctgccgcgccagcgtgaacgttgcctcacgccacgccttccggatccggctggcggcctggtggtggggacggtcgttggccgatagcatctttgccggcgccgggatccggagagtccacgtgcgggtctcagttttggtcataacggtcaccggcctacctccaccagccgcgatccggcgatcctgtacaggcgccgccgcggccggaactcggagactgggcccggctcccactcggacgccacaacacccgccgcctgcagccggtccagcgccgcatgcacacggggctgactgatgtgagccagccggccgatcggatagccgccagcctgcgacggccgcagcatccggatcgcctgcagcacccgctgctcgtcataccggcgctgttgctccctgcgccgcttccaccagccgatcacgacgcatcccagtagtcgtcatcgtcggaccgatcccaagcgggtcggtcggtgtcggacggtgcccgcagtacgtcgccctgcccggcgatcagcacccgggcgtcagcccacgggtcacggtcgaaatgctgcaggtagtcatcggcgatcagatccatcacgccacctcagtcgtgggagtaggagtcgacggtgatcccggacggccgaacagtcacttgcgcatggtcaccgaacgcctccaggagcacatcctcaaacgcgcccgaactaatggcatccgacagtgcccggacacggtcgtaacgggcttcatcaggccccgtgtaagcgcccggaatacgttcccggtcgcgccagtcaaactcacggcggccgagggaagggtggtccccgtagtcgactccgtactcgtacgtgtcgtcaatatcgtccgggtctggatcgttgaccgtcaggaaccacggtgacccgacggagaagacgcacggctccccgtcgttgaagtacggggtgtactgctcccagccgaacgccttcatgtgcggatcgtcaagaacggccctcatcagtggctccagctcggacagcggcttctgcgggacacgcttgtctccgcgggtgatgtcgccctcgaccggaatgccgaggaagttagcgtgacggctcatgcgggttctccttgcagtaggtgagagaggggaagttctttgcgctgtgatcccgacatccacggcttgatcggcatgccggcgatgtagtcggcgggggagggaagccagccgagatcttcgatgacgtgccgttccgcgatcagacggacggggatgtcgacgctgccgtgcccgttgattttcggcacggtgatagtgcggccgaagatgcgctggcacagccaaacgcctgcggtgtggtggtacatggagcgatgacgtacgtcgccgaagatctctttagaggagtccagaaactcctcgacggcgatgtagtgatcgggttcgccgccccacttccgggcggccgatacggcgtgattccaggaattcatacggttcgcctccttaggcagcggagagggaagaatcaagctgggcgcggacctccgcctcaacggcgtccttcgcccaccagccgatgtgcagatagccgcggcacggcaccggcttgggcagccggcgcacgtcggctagaacgaggtgccaggccggtttaccgcggtacaggcgcatgccccaccggccgcagcaggtcagcgacgggtcgtccggctgacgggcttgatggcagccgaccagccgggcgacagcaacgatcgcgccgcgggtcgcggcgtggctggcgttctcgcccagcaggccgatgatccgggagtcactgtcggcagccggatccgcctgcatgccggcgtggatggcgatttcgccccgccacttgatattgacggcccggttctcgacgagcttcgccccgaccgccacagcctcagaccagggagctcgaagtgtgatcgcgcgcagagtgctcaccggttcaccccgaccgcgttgtacgccgacgttaccgacttgttgatcgactgaagagcacgcagctcatcctcaagagccgcagccaactcacgcgcgtacttgtactcctcgtacgccgagtcccgggcatcccgttcctcgattgtcgccagctccgccgcatgcttcttctcggcctgtgtgccgggatagtgaaggaacgcctgcgctctagcgcggtccaaggtccgtttcgcggcctggtaggtcttgtaccggctggcgacgattcgcacaccttttgcgatgcggtccgcgcagttctggatggcttgttccaccgtcaccgggttgtaaatctcctcggtggcactgccgctttctaggtcggtcaccgcacctcaccggccttgatcgcctcaagaaggcgggtcaggtcgaatgcgtccgcatcgtccgatgacttgttcaagaactgctgcacccgctgttccaactcggcggcactccagcgcaactcgccggccaccgattggatctggacgaacactgcatcagcgtcatcagcgaactcggcgtcaaccacctcatccacttccacctgcgagccaggggacgtatggctgtccttctcggctgcgggtgccggcgtcagctcggcggcacgcgctttcagaaccgcctgcagcttctcggtcagcacgccgtccttcgcggcatcccgccacaagtcctgcacctgcttgaccgtctccgcctcgtcggcaagcgtctgaacgtcctcggcagtcaacttcggccgcgcccgctcggcctgcgccgactcgatggcgtgccgctgcacggctgccgcacccaacgcagcccgcgccgccgcacccaactcgccgccgaacgcctgtgccggggtcagccagtcgaagtgcaggaccggcaccatgaacaccttcgactcgatctgcttgccctgcggcttggacgggtcgaagtccttcttctcccgtacctgcacctcgaggcgggccgggatcggctgcggcgccgactcgatcgacgcagcgagggtcggcagctcggcggcagcgttccagccgtggctttcgatcttccaggtgccgagtgacggaacatcggcgagcatcaccgacatgcgcgtcgtcggcttgcacaactcccgggagtcgatacgccggccgccctgctgcatctgcgcgcacagacacggacgctgccggatggtttcggtttccccgtcgcacatgcgatcgcggtagccgttaccccagtgctccatgttcgggtcgatccgctgcggcggcaccagtaccgggatctctttgacgccggtgatgacttcccactgcgggccggtgttggcctgccacgccttcacctcgccgccgtacagctttgcgacagcatcgatgaggggacgtgaggggctggtgaagcgcagcgtctccagctttcccggtcgggtgttgccgttgctggtcggtaccttctgaccgagccggatcacaccgacctgggtcagacgctgctgcagggtctttatggccatgggtgactcctcaggcttcggacgcggtggcgggggagatggcctgttcctgcgcggccttgcgggcgcgggcggccaccgtctccgggaggacaaaggtgcggctggacaccgcggcatgaccggactcggtcagccagcggtacaagttcagggcaggtaaaaacccctgctcataggtgttgcggtcacagacgaccgggcggactgtgtatccgtcgggccggagctggatgatgacgccgccgtcggtgggctgcagcggctcctcatggtccgagtttttgatccggacgacggggaaatggcggtagccggcttcctgcagcgcgtactccgggtagatgtgcgggtcgtcgccctcacgggttttgtagtcgatcagcaggtccagggtgagtttctgcttctgcgcctgccgccatttcaccggcgtgcccgcataggtcagcatccgcgagatgagcttcgccgcagcctcggatcgctcggctctgaaccggatgatcccgtcggtcgtgcctgcggcgccgatgtcccggtgcaccagcagcgcctcagcgagcagcacatcatcgggcacgacgccgtaatcggtgacgaattcctggaacgtcttcacgtacggggcgatgtccgggtcgtggtcgcggatggttccgtggaacgaccaccactccgcaacgtcatgaacacgggtgccctcatcggcgcggcgggcggtctcccgcacgtgtcggtcggcgatccacttctgcacgcagagccggcacacccggcacgggcacttctcgcatgactcagccggttcgtggcggcaccgcgaccacgtgttgtcgcacaaccggcgccgcgaggcagacaccaacgttggcagatcagcaaacgcctgctccgcggcaagcccggcggcccaggggatcaggccgcgtttcgcgatcgcgttgaacgctgtggtgacagacatgagccgctgcccgtcgatgatgtaccagcggccgtcgtccgattcctccaccgagtggaacgggaactcgcggaccgttagtgtctgttcggcaccctcagtgatcggcatctgcggcctcccacatctcgcagccaacgaccgggccgggcttgatctcgcagccgtcgtcgatgtgccccaccgtcgtctccgaggtgcgcttcacctcgccacccgcgctgttgtcgcgccagccgtgacctccgcagccgcggcacgcaggccgcccaccgaggttgacgcccacctcgcagcgttcctcgcccatggactgccacgggccaacgaagtgccggcacgtcttgcagccacgggcgtcggggttccaccagcagcgagccatgtgctcgaccgcgcgctgccgggacgagtgggtatgcccgcagtgcgggtccttgtaccgggtcacccgcaccgggatcgggccgctcaccgcgcacctgccagttcggccagcgcgtcagcaagcgcctgctcgccggcctcactcagccgagcacggacttcggccaggtcggtgacgtcccggatgacacgcggcttcggctccggatgcgcatacggccggcccagccggcactcgcaggcctcgttgtgcagccacgggtcacggcagcgcgcgtacatctgcttctcccgcgcccgagccgcctctttgatctgctgaaagcccgcgtcgatagccgcacgggtcgccaactgatccgcggtcaggggtttcgccaggatcgcttccgtcttgtcgcgtcgagccttctcctcagcccgaagcttctggacagcgtcgtcccgctgctgcctgttcaggtgcgcgacagccttgatccgagctgcatggaagccgaccgtgtagccaccgatgctgcggcagtccgagccgcgcggtgaccggcagaacgggcaggcagcggtacgaggaacctcgtagtaggcccggtcgaagctggcagcggcggtcatgcgaacaccgccgcgaccacgacgctcgtgccctcagcgtcgaacatggcgtcgaccacggctgccgtgtcctggtgcaggagcccgttctggagcagaccgatccgctccagaaccgcgccagacatgccggcaggttggtgtccgggaacccgagccatccccaccagttcgtacaccgcgcccctgtgaccctggtcgagcagagtttcaacagcccgacagatcgtgtcgaaggccgacgacggaacctcagcgcccgtgcgcagcaagaccacgtcagccgggacaaagaacttccgcctcatgcggtcaccgcgccagccgtgtaagcgctgagcaggttcagcgcgtcggcgagcgcgaagctcggaatgagcgcggcccgctgcttcgcggcgttgcgggcggccttgccgcgagcgaccgagtactcccacgtgagagcggtcatgatgtgcgtgccgtcagtgaacttgatgcagcgctcggcgtacggagtcgtcttcgtgttactcgcgaccacccggtaggtggcgggcaggagagtttcggtgctgtcggacgcgacggtcttgatgaccatgccgggcttgaggttgacggtggtacgggtcttggtgcgcacagggggctccttcggtgagggttcggatgggctcacgccttgcgctgtagccacaactgtagccacacttgtgtcatgactcaagggatcctgcgaaccagacacggaagtgacctgtcgccacagtcgttgcctcacgcgaagatcagcacctacgctggcgtcgtgcccgacaacttgcgccgcttccgcatggacgaagagacctggaaggaatacggcaagctcgtcggcgacgccggccggtccgccgatctcaaggcctacatcgaatggcgacttgacaacccggacacaccactgccgggcaagcggcgcggacccgtcaaaaagacccgccccgcaaagcccgaagccgacgcctaacttcacgcggcatcactccgccacaaccagggcaaccccgcgcgcgactcccgctgccgctcggcgacacaggccacgttctgaccgccagctagctgcacacacgaccggcaatcccgccatcccgccgtaggccgcgcatcagccctgttcaagacgactaccgccggcgacgcacggccgctcatgccagcggcggcgacggcgtcttgaccgatggcgatcgccgtcgtcaacgaaccgctacatcccgccatgccgactaccatcgccagcgggcgtcagcgggaccgttaacggcgctgccttgccggttgtctatccagcgcacggactggtaatccggagaccggcgtcgcggcggaacggctcgcgtcatcgtgcagacacgcgcaggctcggacgagcgacgagtcagcacagcacgccaccacgaccgggccgtcatgctgccaccgccagatcccgcggctcgatgaaccgatccaactcttcgccgctaatgcattcggtcagcgccgagaagacgacctcggcgatcgaagcaggtacggcattcccgaaaagacgaacgttgatccgcttcgtggttgtcgaggttcgatacgttggcgcgaatgactgagcgcgagcgatctcgtgcggctccagcatgcggaacagcacgtcgtccaggtcgaaactattagcaatcctgtccgcatccgaggtgaccagcgcgtacttgtccttagtagtcagcgtgccgatcggctgcgacgacggcaacgccgaagtcgacgccccgtaatacgggaccagcagtggccgggcgaacgctacggactgcttaccgctcgccgtcaccatcctgatcgcctcggtggccggcgtggtcccggactcttcgtgacccgaattctggcgcgtgatcagcggaggcaacgccaagccgtgatggttaccggaggcagtgaccgtcgatagcggctcggagatgcgccgggcgttctccttgtcgcctccgccgcgcagcggggtgatgaacggcggaagcggcaacgaagccaccccatcacattcccgtgttgtcctggtcggcatcggatcgagtgccgatgaaggagcgttacgccaggtatcgccagcaggcgacaggaacggcgcgtacgcgtacccggtctcgttgcggcacgtctgcgtccgcaacggggccgatgctggcgcggccgttttgccgtcgcggccctcgcccggaaccatcagcggcgcccagtatcggcgcaccccggcccgcaaccgccccaaggtggcgtccttcaggtcgggaagaccatgcgcggcccgatcgcggatccggatgccaggaacgctcgggtcgatcgcagccaacgcggccagcgtcgctgggaacacctcgcgaccccggcaggaaaccctcgggcactgatacacccactgcgagccgtaggcgcccatatccgcgccgggcttcttgaacacctggattgcctgaaccctcatgtcgcacgacgggcagtgggcgtgcggacgcagccacttgtcccagtccggcagccgcccgatgctcttgtggacgtaggcgatgatcagccggttgcgggactgcggagtcttcagcgaacgaactggctccatgtgcatggcattcagagcgaaaaaccacaggtggtagccgcggccgatgttgcggatctcgcggaggaaggcatcccactcatgccacttgcggcactggatgacgttttccatcatcccggccagcactggtgttccgcggccgttcatggcgcgcaggtaacgggggatttccttcatcagcagccgagagcgtttgtactcctcgagccgcttcttcagcgcgggatcaggttccgcctcggccaggtcaaacagtgtctgcgcttctgcgttggcccggtcgaagtcccgcttcaccccgttcgcatctgtccaggccgggcaagccgggctcgccgaaaacaactccgcgtatggcatcttctcgaccggcagcttcgtgatgtcggcctggaaatgccgagcaccgggaaagttcaggttgtgcgagtcaacggcgtgccggtcatggtttgctgccgcatacacctcaatcccgggcacgtaggatgcgccgtggctagtaccgcccacgccggcgaactcgtcgtagaggcgcagcatcaggccgccgccttcttcaaggcgggccggaccgcgatctcacgccaagtggtttcggagctgtagtggtcacgccggcactgctccggggtagagcacccgacggcaccgcaatagcacgcagggctgacggtcgtgccagaaagttcggggttgtcgtgcgccaccgtgggttcgctgctacggtcaggcatatagagcctcgtctcagggtgattgagcggggtcgagtaccaaaacggtccccaggtggagctgggggccgtttcgcgtttcaggacggcggcgactgcaccggcacgtcgtcgggcaggcgaagggcacgcaggaaagcgcgggcctcgtcttcggtgtggcagtacgtggggattccgtccccgacctcgaccacatagccagccgtgtgcaacttgtggatgctgcccggcacgcgggttagctgcatccagccggcgacacgggcatctgcggtagtggtcatgcggcggcccgccgttccatacggtgtcggagagaagcgctgggcgtgccggtaaaggggccaggcaagtcggcatgcatgtccagcaaggtcttgatctgggcagggctcatgacgaactcccggcggtcaatcgaccgagcgaattggtcgtagatgcagccctgatgcaggtagctccgctcgaactggggatgcatggctgcaacgtcggccatggtgaaccggccgtgttccagcgggaccgtcgtccaacggcccgcaacatggttggccacgactgtcttggcgacccgtaacacctggtcccagttgacgtgctggaagtactcgcgccgatgacgctggcaggcgagaaacgtcatctgagcgatgagggtctgctcagtgctctgatagccgtcgtgctcgtcggacaaccactgatcgaggacttggtgtccgaagccggccgcttcaccggcgtgggtgcgcaaacgtgcctgcggcgtccgggtagagccgactttgatgacgccgttggagaacttgatggcgtaaaggaaaccgctgctcatgcggcccgccttgtcggcctggttgcaaccttgagggtgggcagtggcgtcacggtagagatttgagcgctgggtttgaggatgcgtcgcagttcggtgatctgagtgctggtgagcgcgggggcagcggatacggcgacttcgaccatgcggcgggtctgctcatcaaggtcggccttcatgctgcaccgacccactcgcgctgcggaacactgcgccggttgtagaggggcttctcggagcggattgcagccgtctctgcggcaagaccctcttcctcggtctcaaaccattcaaccgaagcgtgaacctggtggatccaccagcgctgggacttgggatcgcgggagtgctgcttgatccggtgaagcaccgtccggctataacccacgtagagaaggcggtcgtcggcgtcgaagaaccggtagacagccggacgaaggtactcagccagcgcgcattcgtcgcatatctctaggccggctggcgcgtccatgctggtggtgaaccatgtgaggtatcggccgcacatggtctgcgcttggtagcgaggcggttgatcttcccgccaggcaacggcggcagcacgggggaggtgaaaccgtgtgttgtagcgatgcttgttcggggtgtagacgaacgcgttgcgcagcatgactcgtccgaccgggtacttggtctttcgggttcccgtgtcgatgaacgcgcggagcgaccactcgcgatcgtcgagcgggccgccgtggcgggggtggccagagatggaggaaagcgggctcatgccgctgcctccagattgtccggccacaggtcgtcgatgttgcgcccgagacgcttggcgatccggcgggcggtaggcagggtagggactacttcgccggccaggtagcgctcggtgagacggcgggacgtgccaatcaggtcggctcgctcctggccggtggcgcatcctttgtcggcgaaggcgttgaggaacaggtctttgttgaccgcaactcggcttgtgtcgattgcggcgcgccgagtgggcttggctgcgtcactcatggcatcgagcgtaggcctcgcgccagctgtggcgcaagggccgacgcgaaagtgacgcaacatcgtccatgtccgatggacgggagcctttgccgctgctagcgtgcagctaggaagcgcctgttgggcgcgccaaatatggcgcgaggtgggctcatgcgaaccgttctgaccgacacccgctatggttgcgccatgagcggcgcaactccggggccgaccttcggcaaactcctcacgcaaggacgcactgccaaaacctggtcacaggaccgcctagccgctgaaaccggcatcagccgaaccaccatcagccgctacgagcgagagatcaccagcacacccgaagccgaacacgtccgcgctctttgcgcagctctcgacatcgatccgcggcgggcagccgtgagccttggctacctcaccgcagatgagatccaacctgccgtaccggtgccggccaaacttaaagagatccttgatgtcctggaggaccccaatatcccggccgccgacaagcaaagctggattgactacctgctctacctcaaagcgaaggcacaggactcggccagcgcgagctagtgcgctggccatgaacgtttatggggtcggtgatacgccggtcggggctgtggatcacggtactgacccgtccgagggagccggggttgccgcaacgcccctgcgcccgtcggtaggggagcctggtcagtgctcgccgagcaacaagtcagaaggtggccgccggggaggtgtcacgtcagcaagctgggtatcgtggttgcggtgcagggccgtgacgggttcgcttctggtctcgcctgtggtggggtcggtggcgaggagcagatcagtgcgtcgacccgagcatcttggatcatcagcgatgggtgttcaggccgaacttgatgtggcggaggaacgggtatgccgccgcatttagggatcggcccatccctaggtaacgtttgttgcgcctcaggtcgcgtcgccgcgatagcccatgttttcgtaatcgatatcactgggctcgaattccgaatcttcgcgtggcgtatcgacgtatgcataacgctttgcgcgctcaaaaagcttcttgacttcaactagcccgaagacaagctcatggttcgacgggcgaaatcctaagaacaatccaccgccaggtagtttctctatgctggggcttttccgttttgtgtcggcggggttgcgccaggctgcggcttcggtgaagcgagcgtcgctgaggtgctcaatcgtgttacggagaagtcgctctaactccttgtcttctgcgaactctccctcgtctgaggtttcgcctcccgaaactcggtatgcggccaaccattgttccatttggtgagcagccattacgagttggtatccgcgcacccaagattcctccagggcttcgcggaggttagcttcagtgggcgaccagtcctccatgtactcaatcgcccggtcagtccattcggccttaaccgttgcctggtaatagctgtgagcggcgcgctgaacctctcgtgcccatatgctcaacatccgggttacgcgccgaaggtgtatcgcgtcctgctcctcggccgtcggctcgaccggcgcagcctcgcccggaatcggcggaagaaggtacagatcgccatctggcgtcatcgggattcctcgaccaggctgccagaactcgggcggcgtccagtcatcgaacggcgggcgccagttcgcgggcggtggccaggacggcggaggtatgtagcccatcgggccagcatttctcaccactgctccgacagtcaaccgtgttcagtggcatccgagtgcctattttattgatgcgtttgggcaccgagatgatcatgaacgtcaagcggtgagggaatgggtacgctacgtcaggttccagcgaccagtcgactaaggcgacctggcgtgacgtagtcagagccgcggtgaggcgcgcgaatatcgcggcagatccgtatgccttcggttattgcttcttcggctttcggctgacctcgtctcggcttcttgattggcgccacgcgaggccgcacagcattcctccgaaggaagcgaggccggaggccaagaacggtacgttcacattcacgaggtagtcagaggagatcagcagtccaacagccgccatgagagcgcccaagacagtgagcgccctccaagtgccacgtcgcaggtcgcgcactctcgtactcaagcagaccgacaggtacggcacaccaaacttcgcagatccgggcctcgcctacgcgaggccagtggtccaacgtaacgacgcggctcggttcgagcgcggatcgcggctagaagagcgcagttatcgttcagacgatgtccgttctgactggcggagccaggtgcggtaccaggcagcgaaggtcatgcggctgctgtccgggttgtgaaggggacggaagccctctccatctgctgtgtcatcggcccacatctgaccgcgagaggggccagttaccaccagagcctcacgtagggcgcagccgaggtggcagaggtagagcaggcctgtcacgtgggccggatcggagagaacctcgtcgtgcagctcccacaaggcgtcatcattccgtccgatctgcggcgggttgtccaagtcgtcggcgggattgaaggctcggatgtggccgaacggtcgggtgagtgtctcgcggtcattgagagaggcgccgtcgccctcccatgcccaacgtccttctacgcggcgcacagggaagagtccgtatgccgggccggcgccgccgcggctcacatcggttaggaacgaaccgtaatcaaccggaagctcgacacccagctggccctccagctcggcgagttcatcggcggtcaacgcaggtgctagccgccagccgtgcgagatcgcgccgaagacctccgcggcaccggcgagtcccgccaagacggcgatgcggggccggacgtctgaccagtcgatctctgtcatggcgggaccctagcgccacccaccgacaaaatggtccgaggcggcaactctcaacgcactcaattcggcatgtgagcgcggggttggaaggtgtcctagtccttcttcagactccagtcggcgtcgccgtccttgacggtcgcgtcgctgaacgcgctggcgttcgttcgtggccacatgccgcccgggaagttggccgggtcgctggagtcgctgtgcagcgagatcatgactcgggcctggtcgccaaggaaaccggaaagcaggccggccgctgtggcgagcgcggtgatgttgacgccgccttcttccaggaagatcatggcgccgatctccgagaagatggcgctgctgaacgcggccaccgaagcggccgccgcgacgatcaatttcgcgaggactgccgccaccgtgaggtagaaggcggagccggcgatggcgcactccagcagggaattactggtgttgccggcgatcgagctgaggcggccggcggcagcggactgcgcttcggcgacggtgaggtaggcgtccttggcgtcgccggcccacttcgagtcatcgacgacgagattctgggtggtcagctgggtggagacggcgctgaaaccgctcttgatgtccgtccaggtccatgagtcgcggaacatgaagatcggagcgccgcagcctttcagcaggtcgaggatgaagttcccgatctccgtggctaggtctacggtctccttggcgaggtagtggattgcctcggcgatgacgtcggcaacccaccattggcttgccaagtgatcggctgcggggatgacctgggcgatcttggcgtcgtaggtctgcttcccttggttgatctctgcgatcacggcctcgaactgcgccacgctgaacatcgacgtgctcccccgtcagtagacgttcttgatgcggtgggccccggcccggtcctcttgttcgtaggtgtccgcggcctggtgcagcgtgtcggcgatctccttcatcgccgtcaccccctcgttggcgcgggccgtgacggcgtggatgacgtcgttgtacggaccgaccatcatctggaagagcccggcctctagccggccgaactccaaggttgccgtcttggcgctcagcgccttcgtggtgtcgctctggttgttccaggtgccggactccgtgcgcagcgcgtcggtggccactcgcacctcgtcgggggtgggctggctcatcggtgatcacctcggtgctgctgagtccgggtaagggctgacaaggtggccagggcatcagccaccaacgcatcgacctcgccgaaggtcgtggaggacggcttcagctcgcgcttggcctgctgcaacgccgtccgcagagcgccgctgatcgcggtgcccgaactgctgcgcgcccaccgcgtgtcgatgtcgcagccgacaaacccaccctggccgaggcgtacggtgacgttgcgctgggcgtcggtgccctgcgcggacgccggcggctgctgggaagcctgctcgcgggcgttgcgcaaggtcttcatgatctgctcggcgaactcgggatcgtccggctgcggacgaccacctttcggcgccggcgcgggctccgtcactagccagcctgcctcagcgtcgcggcgctgcgcccaccagccggactggtcgagacggccaacccactggcgctgcttcgtcttcaccgcgtcggcgtaggcggccagcacagcaggggcgagcttctcagcctccaggcgctgatgccaccggtcctggatgcggaagtcggccggcaggttgtccgggccgagcgtcgccacgacgcagccggtggcatcgctgccctccacgtgctgcggggcggcggccgccaggtcgctcgcgaccttcccgagctgctgcgcccgctgctgcagctgctgaaggcggcgcgccatgtccggttccatggggttcaccggccacccgccggggcctgcagaacggctcggccgatccagaagaggaacacggtgccgggcgccagaacgatcgagaatcccatcgcgtgacccttcgacgaggtcagcagcgagatagtgagcatgaggacgagcccggccgcgaggaacgtgagggtggcggcgacgattcgcgtggtgccgccgatgccacgccacgcaatgacggcggcggccacggcgatgacggcggcggccagggtgacgatgacggtgccggtgtggccgtatggcgaggcttgtacgagttcctccaggccaatgagcactgcgtatgcggtccccagcagttccgccgctgtgatcatggccatgaggaacagcgcgaacccgctggtcctcgccgttcttgctgacgcccttgccacactgcacccccgggttgacgaagagggacagagtgtctgatctcgaccaccctgtgcaaccccgtgtgaggaacttggccactgtcaaaaacaggtcagtatcaatgtggtgttcctgcgatgttggccacttgtagatacaggccgccgcccaggaaggttcagttgcatcggtcccggatgcggcggtggccgcctggctccagccgctcgcggacctctaccaggcgtgcggcgccaaccttgaggtggccaagcggcagcgggtctggcgggcaactcagccctggtgacgctcagcccgtcgactgggcggccgaccataccgggtgagggcgatccggcgggtcagcagcaatgggtcactgatgttcatcacccacctggccgccgggcacccgcgcaaatcgggcgggcatcccaggtcgcggcgtagctaccgcatcgccttggccacgcggctaccggtaaccgtggtcggtgtcgtctccgaccaggcgtcatcttgcgtgctgacgatgccgcacagcttgcggttcgattcggcctgagcgtgcagcgagattgcgaccgccgcagtgccggtcgccagcgacgatgcgagcagcgccgtccaggtgtaccaggtaggtcggggtggccggctcaccggtcagcccccgtaccggacggcgatcgcgacggcggcggccgcgactcctccggcggatcctgcgatggcccagagcgggtgccacggagtgacgcgtccttactcaggggacggcggaggtttaagaaccccggcgctacgagggcatgaccagcgcgtgtgcctaagaaactgtctttggtcccgtttttccagctcagctggtgtgcagggtgatgttggttgtagtagccgttcgcgttggcgtcacggtgacgtcagtacgaatgccagcctgtagacggatgtggtcgacgggtcgattctgagaatgtggccactcgacaacccccgagacgatgcctgagctgcggccctctcgcccgcgatgcgagtacgcgtcagtggtattgctcgccgtcgtgcgtggggcgtgcttgccgagcgcgacgcaaggctctccgggcaaagaagctcacggcgctggttgtgcgggcgttcgtaaccccgttgcgtccaggctccacggagtaggaggtggccagcgccgagagggcggtcgcgatgatgtcctgcccggtgtgcgcagtgcgtggtctggaagctagtccgccgtcgccgcgacgccgtgtactgcagtaacgcgtgtcgaaccagggcttggcgggagtgccgtacggctgactgacgtaggtgaccatgacgacgaagcgtcaccgtggcatcctgaggatcccccctgtgacagaacgccgtcatggtcaaagaccgagacagcttcttacaagccactcaagccgagcatgcgctcgaccatgtcgaggtcgtaccaggcgtgcgactcgtaaccgtcctcggcactgagatcgcgcagttgaacgagagcgtccgggtcgcctcgcatggcgagcccggtcgcggcctggatccgaatgcggcggtcggagccggcgagaagagcggcgaggtggtcgcgcaattcgggcgtgtcgatgcgtgagtagacgagttcggccgtcgccgcaccgcgtacctgtgcgctcgggtcccgggtgagtccaaacatgaccccgagcacgtgcggtggcgggtcgtcagccggccctcccgtaccgttcagcagctccatggccactcgggtgcgcacgcccgggtgcgggtgaccggcgaagggcaggagttcgacgaggatgtcgccgatatgccggaaacccgcgtaggcgcccatcagcgagtccagtactaggggctccggttcgacggtgatccggtcgtgaagtgcgttcagcgcttgcggggcgtagggctcgtccggtccgtcaccgtcgagggtcagatggtgcatcagctcggcggtgaatcgccgcaccgccacccgcgggtcaccgagccggtcgatcgaccaccggacgttgtccgccatcgagaacctttgctgcagggcccggcggacgttcgaccagtccggggcttccggatcggctgaccgcagcgcccgcgccagcagttcgtccggagacaccggcaggcttagtgtcgtttccaacgtggttaccacgccacggtgggcgagcaaaacctcagctctacggccgtcgagcgcggacagccggagccgcggtgtccgcgggctcaggtcgtcgatgaccacccgatcccgctcgatgacgaccggctcgcccacgcctatccccgcccggcggcgcagctccagctcgggagtggcctcaagccacagccgcgcggcctcgagcgcccgccgaagctgcgtttcgtcgacagaatgccggtgcagcaggttgtccaggaatccgcacgtgccgtgatcggcggcccagaccaccgggtcgacatcgtcccacagtcccgagggcaggacctcgtcctggaaaagcatctccgccatacccggcccgccatggcgcaacactgcggcgccgaacgcccgaatgtcggcctcccaccggtcacccgaggaaatcaccgtcaggaaccgccgggcctcctcgacgtcgccgtcacggatggcatcgatcaccctctgctccacccagcaattctggcgctaccgccgaccggcgccttcccggggtggtcgccgcgcctgatgttccgacggcgatgccatgtcggatgctggggtggctgtggggaccggccgacgcccggggtcgtccttggggccgaccgcttggcgagatcacgactcgctgacagcccgcgatagatctcccgtacggatgaccgcgtgtgcaatcgacaggagaggtagtgacagaccgagacaaaaccggttggaggacagcttctaagcctgttctttaacctctggccttgggcttacggcgaggcgggccacccagcgaggtttcgcgtttgacggttttgcccacgtcgtagcgggccgcgcggctgtggttcttcgatccccgcggtcgtccggggccggggcgggtgggtttcggtgctgcggctggtagagccgatctcgtgcggaggtttcgaaaccctcgccggacccgggctggggtgagtgcctcgggcgggaccggttgttcccagggccggcgtagatcgatggcgataggtcgggccagtcgtagttgggtgtgggcggcgatcatgatcaacgtccaccggtcggctgcccgcgggtcgcgtattttcggcctggtccagccgagcgtctgcttgaaaagccggaacgtgtgctccagatcgaagcgccgaaggtaggcctgccagatccggtccacatccccggggtcggcgccggtgccggaccaccacagccacatcggttgcgcggcgcggtcaccgggcaggtactcgacctgcagtcggatgagggtgccctcgacgatcgggagcgtgccctgatgatcgagccaggcggcgcggtgggtcagccgcggatgcaaccggtcccaggcccgggcttcggcttttccatagctgatcgtttcgttgatcgtggtcgcggccggctcgggccaggtggcggagtctttcaggtcgaactcgccgccgtgcttgggcggacgaccgccggacgggctgtgctcatacggcggggcagggagccgcaggacccggtcggcgcggatacgcccggccacctcgaccggcagatcacgcaggacccaggccagccgcgtcacgtcgtagccggcatcgcagacgatcaggatgtgcgggtcgccggcctgctgctggccgcaggcaatcagccggtcaaccaccccacgcaactgggtcgcggtgaccgcggtggcgtcgtcggcagggccgagacgcaccacgtccagcatcgccgtccacgacgtccggccaggttccagcgccgcaacgaaggagtacggccagccgggaatgaactgcgcggcgctcttggcgcgcccgtacacgtggcagaacagccgctctgggctgcacgcggcgtcggatcgcagccacggtgacacgtcgaccgccagcacgatccgaccgtcggcgaagcgtggcagcggctgcgcagtcaacgcccgtcgcagccgtcccagatcgatgcggccgtggttgagcgcgtcatacaacgcgccgtgtccgcgccggtgctcggccgtcaacgtcagatcgaccaacgtcttgaccggcccgtccgcgcacaacaccgcgtcggacagctcgaacagcgcgtccgacctggcagtcaagcaacggtagaactcatcccggaaagccgccaggacatcggctccccagcccctatctgccacgatcactacaacgaacgtcgatcagaagaagactcggatccatccgtcgggcccacctcaaccggctccagcggggagcctcggccgccgcatacgcggcagcggcgaccccaccagctcggtgggcgaggccagaccacgtccccgtgagctgctactttggcggtcctatgacgcgacgattcggtgaccgagccagattcgctgtcgaggtgggcgaggtctggccaccgccacccgccccggccaccggagagctacgcaccgtcgatctttgggccgccggcacgcggatgaccacagacgacaacacggtcttccttcccaccttcatcggtttcctccgatccacggcagccaaggtgcggcgccgtcaggtcagtccgtgcccgtttccggaacattcaccagaagaagttttccagctcctctacacggacgacgagaccgacttccgtgagcagttttggctgatgcactggggcgagaccgtcgacaacgtgacaagctacgcctacctggacgacgacgacctagtgatcgtcttctgactctggcaagccgagcgtcacctcccggaggcccgcggcaaggtcttcgttgccacgatcacggcggacgagttcgcggccctcctcgagggagccgccgatctcctcgatgccgagcccgttcgatagaaatctcgccaagcggctccaccaagtcaggcagcctgccccgccgcaagccgagagccagaggttaaagaacaggctaagcttgtcgtttaacctccggctccagcccaatgctgccgcggaccagccgctgcgtcatcagcagcgcccacagcgagtgccggctggtgccgggctcgggcggcgacgtgacccagcgcgcgttgtctgcggcaggtccggacgctggccagaacgcactcgagtaaggtgcgcgtcgtgaactggcaggatcctgagattgccgctgtagagagtcgcgaggatctcgctcgctacttgatgagcttggcagcccggcttcgcgaaggcagtcttccgaccgaaaacccatctacaggcgccttcatcgacgccgcgggccgctggacgaagtccatggacggcttcttctcaaacgttctgaaggagccggttcccgacagcccagattggtcgacggtggccgccatattccgagcggcgctggtctacgagtaggggcagagccaagatcgggtgcccggtcgtcggcagatccgtgtactcattggattcccctccaagccgactgtcgtaactgagcgtcatgcggcgcttggggtagttgccgcttcggcatgctgcggcccgcggaaccgtgtccgctcctatcgatgctcgttgtggcggtcgtgacggacagggcgaaagcgatcgatgtattggcggagttccgtgaggagctctaccagtgcatgacccggcgggcggacgccttgttcgaattgaccgaggcgctgttgtgcaccgaagggccggtcaagaccttggtcgggttgtctctggcgccggagcaccggcgtggccacggcgccctgtatgacgcgctgaaccacggccgtatcgatgtcgaggtgctgcgccggcagctggccggcttgccgttgccgcgggcggcggacggccgcctggtcctcgcggtggacgtctcgccgtggctgcgcccggacggcaactgcagtccgcagcgctcgttctgccacacctacggacgcggcaaggacgaacaccggatgatcccgggctggcggtactcgatcatcgccgccctggagaccggccggacctcctggaccgccctgctcgacgccgtccggctactgcccggcgcggacgtcaccacggtcacctgtgcgcagatccgccagttcgtcgaccggctgaccgacgccggccagtggcaggccggcgaccccgacatcctgatcgtgctggatgcgggctacgaggccccgcgcatcgcctggctgctgcgcgacctgccggtggagatcctcggccggatgcgctccgaccgggtgctgcgccgagcgaccccggcccgcgtctataagccattgggtggtcggccgaccaggcacggcggcgagttcgtcttcggcaaccccgccacctgggatatcgagcacgcggtcacgcacaccgatacccggctctacggccaggtccgggcgcaagcctgggaccgactgcacccacgactgacccaccgcgcggcctggaccgaccatgacggcccgttgccaatcatcgaaggcacggtcatccggctcaccgtcgagcacctgcccagccgcggcgagccgaagccgctctggctgtggtggtccaagctcgacgccaccgccgccgatgtcgaccggtgctggcaggcgttcctgcgccgcttcgacatcgagcacaccttccgcctgctcaaacagaccctcggctggaccgccccgcaactccgcgagcccgccgccgcggaccggtggacgtggctggtgctggccgcacatactcagctgcgtctcgcccggcccctcgcacaagacctgcgccggccttgggaacgcccgatggcgccggagcggctcacgccagcccgggtgcggcgcgggtttcggaacctccgagcgaccaccccttcgccagcgcatgcgcctaaacccagccgcccaggccccggacagccgcccggctcccggaaccggcagcccgctgcccgtcacgacgtcggactcatcctggtcaccggccaggctcaccagcgaccggcccatcacaagaagggcaccaagccccgccgaactggttaaacgacaagctaagcctcggccggcactgacttcgacgccgagccggtgctcgaatcaacagtgcgccaggcagcgcggcggaatgctgcccaggtcacgggctccaagcatcggcgaatcgcctaccggggacaggtgatcaaactgcgctgaaggttaagacgcaagctgattcaacgcagtagctcggcctcaccgaccgctacgagcaactcagtcggtaactccggatcgccatggccaacggcgagcgcaacccaccgaccaatgtccagcggccgccaggcgaatatctcgccactgagttggcaaagctggttcatcggctccggcgcgtggtcctcactccagagaaaaggctcgagatcgacggtctggggctcaccccagcgggccgtcagcgcggtcgccaacgtccgaaaaccggtgtcgatctcggcttgcgctgtctcgacgatctcctcgctacggtcatcccagaaactgcggctggcctgcaggacatacacatggaacccaggcccgctggaccggcggccctctcgcatgctctcacccggaaaaggaagcaccagcaggccgtcgatgatcgcgagtcggtcttgtatcaccatgccaagaggctagagaacccggcgaacgtacctggtcaccgcactagaccctgttcgcgccacaggtcaccccatgtccgatgctgaccccgccagcgagaatccgccagccgccacggcgaccacctaccgccacgccccaccggcgccaccactacctccgccaacaacgacaccactgtgcgacgttcaccaggggagtacgacagccagttatcggccagatcgatcggatcgtagccacgcaacgccggcggcgtcttcaccgctttcaaccgccgtgacgcctcctcaatcctcggcaacaactcctgctccgcagccgccaccaacgccatgctcggcccgccagggcgcgcagccgaggagtacaactccttcttgcgatccatcaacgcatccagctcagcctgcgcctgttgcgcctgaaggttcgcatccgcagacggctcaaacaccgcaagcgcatcaggctcccgcagccggtccgtaaccatcgccgacaccagcgagtccaccggctccatctccgtgctgacccgacagcatccaccacgagtgatcatgcattcataccgagtacctgcggtcttcctgtcgtacagccccgacagaggccggcggcacaacccgcactgcaccagcccggacagcatgtacttcaaccgggtgtcattgtggctccgcgatgttcgcggcgcttcccgcaactgccgaagacgggcaaccgtgtctgcatccaggatgggcggccacgcatcacgagtaatgatgatgccgttaagttcgcggtggccttccaagctgggccgcagcagactgttgtacagggcgccacctgaccagcgggtcgcaccgcggggggtcggcacctgccaggcagtcagcacccgggcgatgtagttgacggggactccgttgagaatgccttccgccgctgcccggtagatcgccgcccgatcctcatcgatgacctgctcgacatgaagcttgcgcgcgttcaacaaactgccgtccgcgtcttcatccggggtggtgtagatccgcttgtagccgtccgggatcttgccgtgcggccgaccattcacggcggcatcagcaatccccgcccgcgaccgggtgctcaggcgctctgactcgccttcggcggccatgccttccttgaacaggtggtcccggtcgcgctgccgtcgaggatcgtaggtttgcgggtcatcatccccgaagatgcggatcaggatgcccttgaggcggcacaggtcgatgaagttgacccactcgcccatctgccgggagccgcgggatggctcccatagcgatatgacctggcagccgtcctgcctaatgtggtccagcagtgctgcaaagtccggtcgtgccttcttggcataccggctggcggacagttcggggtcgacaaacacccggccgggggtgaggccctccgtagcgcagtcggcccgccaggcgcgttcctggcgggccacggaccggccggcatctttggtgcttttgcgggcgtacagatcagataccggcgggctgtccacctggtggtgaggcggcgtgtgctggtgcgggatccgactggttgcgggcattaccgcaccgtactaggcataccagtgttgtggaagttgtcaaccgtgaactgctgttgatagagcgaccagaacgcggcgctggccaggaacatcggcaggaacgcccagaccttccgccgttcccgcccgtcgagccggcggctgctgaggatcaccgtgaagtaggcggccgcggccaggatgctgagcaccaccacgacggtggacaaccggtcggcggtgagccaggtcagcgcggacaccacgatgaccgcgaccccggccagcaccaccgcggcgacgaccggccagcggcccggcggcagcgggttcggcaccgcgcggccggcgtccggcaggttgcggcggcccagcgcgtactgggtcaggccgatcgccatgccgaccgccgccaggccgaacccgtagtggaagcccaggttcttctgcagcagcccggtgagcagcgggccggccagtgcccccaggttgatccccaggtagaacagcgagaagccggcgtcgcgccgctcgtcgtgcgcgtcgtagagggtgccgaccagcgaggtcgcgttcgccttgaccccgccgctgccgaccgcgatcagcaccagtccgacgccgacgccgaccaggcccggcagcagcgccagcgcgatgtgcccgcacatgaccaggatcgcgctgaggaaaagcacccgttccgagccgagcagccgatcggcgacccaggcaccgagcaccgtggagagatagaccgccccgccgtacgcgccgacgatgctggtggccgtgctcttgtcgatgccgagcccgccgtccgcggcctcgtagtacaggtagatcagcaggatgccctgcatgccgtagaacgagaagcgttcccacagctccacgccgaacaggttggccagtgggcgcggctgtccgaagaaggtggccatgccacggcgtacccgcggatcgtcgtcatcatgcatgagccgccgccccctcgcttgtcgcccgagcgccccgcgaccatcgcggggcgctcgggattgtcgatgcgtacccggctcgacgcggatgccggcgacagcggcggcgagctgtcgggtgctcagccggtgatcgtgttccaggagtagccgaggagcgcgaaagccgccccgagcagggcaaggttgaatccacgggtggtgatcggcagcgccgccaccaccaggaggatgacggcgatgaggtagaagactccctgaatggacacgttcgctcctcgagctggggtggaaagcggcgacgctgtaccccgcggcagcgcggcgctaaacccgccggtccaggtggacgaggacggccgggacgcgacggtggtcgtcggtcgacggcagcaggttcatgatggacagcgtaagagctgaaaacgcctattttgtacgtcgttttactccagtccggggacccgctgccgattcggagcgccatgagctcccgcatccggcgatccgccctgttcggcgcggccgtgctgctggccaccccggccgccgcgcacgccgctccggccaccgccacgaccaccggcgtgctccagcagaccgtggccgacacgttcggcgccggcccggaccgcgtccggaccacggtccgcaccgacggcggcgccaccgtcgacgtgccgggcggtctggccgaggggatcaccccgggcgtcggggtcaccctgacccggcgggccgacggcaccgtcagcgggctggcacggcgtaccggcatcgccgccggcacctccccggtgtccggaactcatcacctggttttcgtcccggtccacgggtcggccggcaccgacccggcgaccctgccgaccgccgccgacttcaccacggtcaccgcgagcgtcgaccggtactacgacacggtgaccggcggcgcggtccggttcaccgtcgaccgggtcctcgccccgcagaagctcaccgccaccggctgtgacaccgccgccctggagaacgcggcccgcgacgcggccggcgcggtcacccaggaccggttccaccacctggtcgtctactacccctacgacgcgacctgcggcttcgccggcctcgcctacgtgggcgggcagttcgtctggctcaacgggtacaagaccacccaggtgctcggccacgaactcgggcacaacctgggactgtggcacagcgacggctaccactgctacgccgagccggcccggcagaccccggtgccgctctccgcgaactgcacggtcgagggctatgccgacccgtgggacatcatgggcagtcgggccaccggcgaactgaccgccgcccacctcgaccagctcggcctgctcggcgacggcggcacccagccggccgccgccggccgacgggtcgtgctcgcgccgctctccggcggaaccgggctgcggcagctcaccgtcaccgccggcacccgcacctactacctggagtaccgcgacggcggacggctcgaccagccgtacgcgcggtccggcaccggcctcgccgtccggttcaccgacaccacgctggacagcggctacgcccacgaccaccagctggtgagctaccacccggaggacggcacgatcaccctcaagccgggggagggctggaacgacccgggcggcgcgctcagcatccgcaccggggtggctaccgccgacggcctgccggtcaccgtcggcggggtcgccgacaccaccgcgccgaccgcgttcaccctcaccggcccggccgccggggcctcgctgaccagcaccaccagcacggtcacctggaccccggtcaccgacgacagcacggtcgcggcgatcaccgtcctcgtcgacggccgggtcgcggcgaccgcgtccggcaccgcgaccgcgaccccggtcgccgtcccggacgggcggcacaccctgcaggcggtggcaaccgacccgtacggcaacgccagccgcaccccggcgatcacggtgaccgtggacggcaccgccccggccggcaccccggcaccggccgcgatcccgcgggtcggcgcggaggtcaccaccggcggcatcccggtgcgggtcgcctgggggctgaccgacgccaacggggtggcgcggcagcggatcgcgcaggacggggcgacgtacagcaccctgggcacctcggtgcggcagatcgacgcgacggcgaagccgggcgtcaagacccggtggcagctggcggtcgccgaccggatcgggcacaccgggacggtgtccggggcgtggacgacggccagcctgaacaccaggggcggcacgttcagtggtgcgtggcggaccgtcagcggcaggtcgctgctcggcggcagcgagcagacgagcacggcgaagggggcggccgtgtcgtacacgttcaccggtcgggcggtcgggctgatcggcacccgggacagcgggagcggggcggtggacgtctacgtggacggggcgaagttcgggtcgatcacgctgtacaacggggtggtcagcagccggcggctcgtttacacgctggtgtggtcgggggcggggaagcacaccgtcacgttcgtgaaccaggcgacggcgaagcatccgaagatgagcgtggacgggatcgtgagtttgtcctgacgggggtgtcgggtccggtggtggtcgctgcgcggcggggtcgcggcttggcggggtcgccggccgtcggtgcgcgcggctgcggtgctcatggcgtacaaaatagtatttgttggatttgtcggttaggtgtggaggcggccgaagatgtgcgggcgctcggcgcctgccgcgtgaatgccgatcagcgcggtgtgccggtcgccgtcgcgccacagctgcccgcgcagcgtgaaccggtcaccggcccggaacgcctcccggaagacgaccgcgatccgcccggcgtcacccgcggagatcggcagcccggcatcggcggccagcccggacaggtgatcctccagcagtgccaggtactcaccggtgaagacgatctgaccggtgtcggtgtgctggcggccgaacaccccgctccgctcgccctcggcgatcatctcaccgtcgaccggcgccaggtccgccaccgacgggtgcggatccggcaggacgtgcacgtccatgtgccgggtctgcggcagcggcgcaccgaccacgcggctgcccggcgcaccgtcccggcggatcgtcgtgagcagcagccgcacctgcccacataccacctcggtgtccgaaattgactcccgatagcgggacgggtcgccggtgcccggccggcagcggaacgtgtattcgcactcgaagcccagccggctggaccgttgccccagccccctgccggacagctccacctgccgggtcagcacgtccacggacagcgtggcgctgaccggcagcggcaccgggaatcggcggaacccggcatacgtgatcaccgaaccgaacccgtcggcccgcatcgaggccacgtcgagatgcgcggtgaactgctcgtacatcatcgggatcgccaccgtgagcatggtgcgggccttgagccggaacccgtcatcgagatccggtatgttcaccgccgcctgatgaatcacggtcaccatgatggcgcaagtcgatgtcacctgtggtgtgccgggcaaatctgcagaatctcggacagccgattcgtgaccggccgcgcctccaggtgcaaccgggcgatgttcaggccgccctcgccgatcaccaccagcggcgccggctccccgatcccgtacaccgtcaggtgatcgttctggtggtgcatcgtcacatcggtgaagccgccctgcccgagaaccgccccggtggtccggctgatcccatgcgccccggccgccagcgccgccacgtcgtgcggctcgatgccggtcgtcgtgtcgtggaacatgagcagcccgacacaggaccagccgcgcaccggttggtcggccaacgcctcggtgtcgtcgagcacccattcggcgaaggcatcggctcgtccggaccgtgactgaacagccgcagccggtcgtttcctccgcgcaccggctgtcgttcaccgcgcccggccgctccgaacgggtgaggggccgcctttcagaggcaggctccggtgagttcggcgagcagggcgaccaactttagccacagtttgaggaactgtgctcggtgagtcgtcgcacctgctcaccggcggttgattgtcagcggccgccagcgccagcgggcccgaaccgacggccgctgacctctcaaatccggctgaggcccagatcagcgaagagttgtcgggtggccgggtcgaccgaatacagcacggtgccgcggatcgaacgagtcatgaggacgccgtaggcgttgcagatcgcccgtagcagctcctcgtcgtcaccgattctgttcgccttgctgagcacatgctcgcggtggacccgccacctgcggccgtcggtggtcaggtccggtcccatgatcactccgccccactcgtactccagaccttgcgcggtgtgtacacacccgatctgcccgaagcccccaggctcggtcgcccagaatcgccgtttcggcacgccgggtgtcttgtggttgtcgcctgcgttccaggggcgggcccagccggcgtcaggggcgacatccgggaacgttccggtgtcgtcggtccagttccaacacatgccggcgctgatcctggcactggcacccgaggcttccttgctatgcagaaaggactccatccgcgctgcgctggtggcgtaataaagttcgaagggctcggggtcagagtcagcgtcggcgttccatgggacgggatcaccggtcaagagccgttggatccacgtgtcgtacgtcgcgctgcccaccgcgcgcaacggcctgtccaaggcgatcggtacgacttcggcacccaagcgctggatttctcgtttgagggcttccgggctccagacttcgtcagcgaacaggcgctggtcaccgtcgatgaagaagacgggcaccttggcgcgtgtgacgaccacggcgacagacgtttcgccggggcgtaccgagtaggaccctctcatcggttgcctggtaagccggtgcgcctcatcgcaaaggatcagatcctgctcgttcacgccaatgttgtcggcgacattgttcaaggtggtgaaagccgggcggtggccgattgaggcgcgtttgaaagtctcgcgtgacgcgattcctccggagacgtagcgaaccttgtactggttctcgatcgcctttccgagcagagtgagcgcgatcagtgatttcccggtccctgcgcgaccgcttacgacaaacaccttctttgcgccggacgatgtcgtcgcgcgcagcgagtccatcacgctcgttacggcgtgcagttgattctcgatcaggctgaaccgcgtgtgcccgtccaccacggcgcccagctcgctggtgatcggaagattcgtgcggcggcgttcaagcagtgattgcgcggccctggtgccggctccggatccgaagtttctggtaaggaactctcggagggagtcgggttgccgggctgtgaaggtcgggatgtcgccgcacggggcgacgttacttatccattggtgttgttcgtccttgaggttgtgcaggtaggccgctccgacaaggttgacgtagcgatcgtcgaacatgctgtgatactttttcagtgcgatcagattgtcgcgcacctgaatcgcgggatgctttttgtgtttactgtaaaaaggggcgtagacgcactcgacggcgcaccgctcacaaagcgcagtatttccggccgccttgcaggaggcgcagaggccggccggatgtgacagagtgggtcgttcgacggaaccccattgtttcaattccagggcggcatagctcaggccgtccaccgggtgacttccggcaagaacaacatcgatgggattcatgtccggggcgacgcggtactcgatgaacatccagacctgccccaggcccgaatcgacaagggtggtggcgacttcgtagaggctctcgcgccaggactggacttcgcttctcgaggggcccgagccgttcgggtgggctctcttgtagcaatcctcgacttccttgatcagcttattgcggcgtcgcaccagatcgtcagcggtccgatatacttccagcggtgcccatgcgccaccggcagtcattgtttgcccgccttttctgtcgccgcgtcggcaaccgggaaagacgtcgctgatcgaccgttctctgagctgaatgaatgttcccggtcgggctgcgacatgaactgttgcagccggggcctgaagctttccctcggggagcctgatgtcttgttgaatccggtgctgtcgatcgtcctgccccgtatcatggtcggactttattgtttttactagtggacttacgccaacttgtctttccgcaggtggtcttgtgactatggtcaggcgttgtagggaagctgttcggcaagcctgattggcgttgaggttcgtcgcgttggttgagcaatcgtgttgcatcggccgctagttcggttccttgaagatcagcaatgatcagcactgttccggatggcgatgtcgggcagcccgtcagtgcgtcgctctggggtgtagagcaccactgtcaccaccgcaacgaggcgttatcggagctggccgcgcggcgggatacggatggttccacctgccaggcgcgcccacctgggcgcacccatcggaatcggccggtcggggctgccctgctacgtggtggaatgccaatccggacttctgttctgatcaaggtgaatggcaaagctgatgggtaactcggcgggttggtcacgccgtacttgcaagaggcctcggcggcggagcggagaaggcagccctggtggtgccaactcggctcgttccgggtggatgacctgggaagattcgccgcggcggagggccatgtggtccttcaacagaggctggagcccggtgactaccggcgtcgttgcgttgtcacgggtcgaaccgagtcccgtgtcgggcgtgctggctgatccggcgctgttgacgggaggcggagatgcgtgacgcgacggcgtttcaccagtggtgtacatgccctgcgcgccggccccggccgaagggagttgaccgctgatctacggcggaccggggacaggcgggtggtgttgctggtctattcggcgatggctcgccttgtcggccgctgcggtgcggagcagctgtggaccgtggtgatgagcagagacttggagcggatccgggccaccgttcctgatcgtttggctcaacggtgggtgatatcgccgggccgtgctgcgatctcgcgactgacctgcggctcccggagagcgaagctcatccgctactccctggcgccatcacctctttgcacccttgtcgcgcgacacctgttggggcgctatcgagcgacaagggtggaagaggaaggtcgccgggtaggtaggtcagcggtgggggcggtctcggcggacggtcgggcggcggcctcggatggtgctgtgggagagggctcggatgacgcggtcggcgtcggtttcggggacctcgaccagggcgaaacggtcggtgatctggatggagccgacgtcgcgggccgggaggccggcctcgccggcgatggcgccgaccaggtcctgggggcgtaggccggcccggcggccgaggccgacgaagatctgggtgaaggagccgcggttgcgggcggaacggcggtcggtgtagcggtcgtcgcgggggtggcggtcggagtcgcgggagcggtccgtgtcgcgggggcggcggtccggatcgcggcccggggacagcgacgggatctccggctcgtcgacgtcgccgccgttggcctcgtggagcagtctgaggccggccagggcgaccgtctccaggtcggcgtccgcggtgagcgaggccagaaccgagcggaaacggtccaggtcgtcggcgtccatggcctcctggacggtggagcggaccagttccaggcggcgggcccgcaggtccgtcaccgaggggagcttctcgacgacgatgcgctggcccgtcagacgctcgatggctttcaggaggcgctgctcgcgcggctcggccagggtgatggcggcgccggtgcggccggcccggccgacgcggccgatgcggtggacgtacgcctcgggggccgacggcaccgtgaagttgatgacgtgggtgagcaggtcgacgtccaagccccgggcggcgacgtcggtggcgaccagcagctcggtggtgccggcccgcaggcggctcatcacccggtcacgctgatcctggctgaggccgccgtgcagggcttccgcgcggtagccccggccgttcagcgactcggtgacctcctccacctcctcgcgggtgcggcagaagacgatggcggcgcccggcatctcgacgtccagaatgcggcccagggcggcggccttgtgcgggcgggcgaccatgtacgtgctctggcggaccgagggcagcgcgtcggcggccgcggtgtcgcggcccatccggatgcgcagcgggtcacgcaggtgccggcgggcgatggcgtcgatgcgcggcggcatcgtggcggagaacaggacggtctgccgctccgccggggtctcggccagaatggcctcgatgtcctcggcgaaacccatgtcgagcatctcgtcggcctcgtccaggacgacggtgcggatcgcgtcgagccgcagcgtctcccgctcgatgtggtcgaggacgcggcccggggtgccgacgaccacgtcgacgccgcggcgcaacacctgcagctggcggctgatcggctggccgccgtagaccggcagcacccgcacgttcagatcacggccgtaccggtgcaccgcctgggagacctgctcggccagctcccgggtggggaccaggaccagcgcggtgggagtgtcggccgaaccgggggtgaggctctgcagcagcggcagagcgaaagcggcggtcttgccggtaccggtcgcggcctggccgaccaggtcgtggccggcgaccagcggggtgatcgcctcccgctgaatcggggtgggctcctcatagccgaggtcggtgagcgcacgcagcagctcggggcgcagtcccaggccggcgaagcctccgtcggtgctgttcgcgaggtcttcgtccatgaggaacaaggatacggaccggcccgcaggacagcatctccggcagtacccccggcccggccgggagcgcgagctgcggtagaggtcacagcaggggctgccccaggtggcggaccgggcggtcaccgatcaccgcgacgaccgcatcgatctcgaagaactccgtccagtcccggttgacgacgatctcccgcggcgtccattggacggtcagcacgtcgtcgttgtagaacagcgcgccgcttcccccgaaacggtcgtagaacgccaggacagcgccgaccatgacggcgacattgtgatcacgggtctgcggatcggccagattgtggaaccggaacgtggcggtcacccggtgatcgaaacccaggcggcgcgttgtctcgtcgcgctcgtcctccggcggccggtccggcgtcacgaacaggccgggaaggacgatcgtccggtccgtggcgagctcgccgagtgtcgactcgaagaacccggtcagttcgtcggaacggacgtcggcgtcgctctgcacgatgtattcggtagccatcgccggtcactcaccaaaggggtagaagggcatgatcttgtcgtccctcaccacgattatctcctccaggccgcggatcggcttccggcgcaacaccgcggctatctcctccagcgagcacgacgtgtcctccatcttgaggacgaagcgcttggcctgtccgtcacgcaatttcttgctgaggctgttgcggaccttttcgggattgtcgctcttcggggcgtaacaatcgacgtattcaccctcgacgcggtagtcgggattccttccgttcgctctggtaggcgggttctgttcgacctggtaaccgttccgcgccagggtggcggcggcctcgtcctcgcggcgccgccccagatcctccgggcggaacggatgcgcgccggtgcggttgccggtggggcgcagaccagggtcgggcgtccgtgaagggcgggtcagcggcggcccggcggtgaagggcgggaccggcccgtgcgtgcgccccagaccggcgatccgggtggcgtccgcgtggccgccgccgatgctgcgggcggacccggtcccctggtggtgcgggcggtggccgggccccgggccgtcgtggtccttcgggtgaggcatcccgctcagccgtcgatcagatgcgacaggttggtcaggctggtcgtcaacgccgtcgtgtaccccacgatccgcgccgcccatgtcgccaccgcggccacgatctgcgtcgccaccaccggaatggtcaccaccgcgagggcttcggccgcccacaccgccaaccgtgacaccaggtcggcgatcagcccgcgcaccaggtcccgggtgaaggccaccaggtttccggcggcctcggtcgcggcggacatcgcggccgccgtcccgctcagcgtggagagtgcggcgacattgtgggacatcatcgcggcgtacgccccggccgcggcgccctgccagtcgggcaggtcgccgtgcagggaccgcttcaggtcggccgcggtgccgtccaggtcggcggcgatgtgctgccaggtggcggcgtgggcggcgacccggccgggcgcgccggtgagcatgtccagcatgtggcgcaggggctggaagtattccatcgcccagccgaggccgttggcgagcagggcgccgcacgggtcgatcgcggtggacgccacgtcgactccggtggtggcgccggccaggagcgtgtcgatccagtcgccaccgcggatggtggcgatgagtccgtcgaggtcgccgaccatggtggcgtcgagggcggcatcgccgccggagtccgccacggcgacgagggaggggctggtcacggtagatcacccggcatccgagaagaaaggagcgtgacaagaatcgggcgcgacagagggtggggactggcggagagggtcagatcaagcggccggcggtacggatcgtcgcggccgaccggtcgtcgctggcctcgtagtcggtggctgccgcgtgcaggtgcccggcgaggatgtcgaggttctccgcgacgtacgccaccagctcgtcctggcgccggtggcgggccgcgagcagcgccggcagccagctgcacagcagcccgtacgcgtgcggatcgtgggtgatgaacccactcgcggcgcgcacggcggcgaaccggtcgtgcagcgcccgcagattcgcggcgtgccggcgcagctggccggcgtcgacgagcaggccgtccggcccggcggtcatgccggctcgcccaggctctccgccgtgctgatgatcatctcgcgggcggcggtcgagtcgggtccgacggtctcgtcgatgatttcccgggtgagccggagcgcctgccgccgcgcggtctgcacggtcgccatcacgatgcgcgccacgtggacggggtcgtactgcggcaggcgcgggccgaagcggatgtcgagcagcgcaccggacgagttgatggtgacctcgaccaggtggcgggggtcgctcgcggtgacccgcagctcgcgcatccggaggctcatcgtcctggtgcgggcgagcatccggtcgatctcgccctgccaggcgcgcacctgatcgagcgccgcgtcggggtccagcaggggttccgtgttcgaagccatgcgagttccttcgtcgtcgtgaaacagcggagaggatctggctggccggccggaactcaaggtaggcgatcggtgaccgcgccgcgacaggcaatgcgcggcctgtggataactatcgggtgcagccgggaaagcgctggtcaccaccctggttgacgatttcgatccggtcgagcccggcggcgcacgtgtcggcgttcaccgcggtgaactcccgttcgaagcggtcgcggccggcggcgtgggcgtagccggccggggcctccacatagagcagcgcgaccttcgacgcgccggccggcgcgtgggcgcgcaggtcctcggcggcgcggcgcaggttctccgcgatcgactcgctgctcaccgacttcgcctggatggcgtacgtcggggaccccgccgtccggacgacgatgtcgatgccgcccccgtccagggtcaccgtcgcgtcccggtcctggcgcaggatccccgccgcgatctgcagttcgcgacgatatccggtcttctctctgaccggcgtgccgggcgccgccgtgtcgtattcgaagatgaggttcgccagtttgccgtagagaacctccgggttcgccagtcgccgcgactgcaccagttccccgatctccggcagcgcgcccgcggtgatcgccttctccatctcctcggtggcccggtcggcgtcgaatctcccggcgccggccatcgcgtcgagggtgaacagcatggccggcatctggctggggtcgagccggctcagcgtcggtgaccgcccgggcaccagccccctctcctgcagccggcgcatcagtttcaggttcggcccgtagatctccgggcagtacgcctgtgcccggtagtcggcggacacgttccggttggtcggcgccgggttcgggaacgtcatccgggcggtcgtccggctcgcgccgggcggcaccgtgccgagtgccgccacccgggtctccggcatgcccggggtgaccgaggcgatcaccgaggcgtcgcaggcgacctttccgacattggtggcggtcaccgtccacgagcaggtgaccgtgcggcaggtcgccgcgttcaccgtcacgtcgaaggcgggcagccgggccggcgtcttctgctcctcccgggcgtccgggacggtgacctgcggaacggccggggctttcgggtcgaccagcacgctcacgtagggcggggtgggcgcgctcggcgatccgttgatggtcggggcgagcggcgtgccgttctgcagcggtccgccgaaccacagcaggcggtacggcctggaccggctgaacagcacggtccagccgtcgcggcgcagtccgacggccggtttgccggccaccgagtcggcgtccggggctgacgcgccggcggcgcgcacccagtcgaccagcccggccagcgctcccgggtccagcccggccccgtcgagaggaaacgcgtagtgctcagggcgtacccaagcgtctttcagaacgccgatccgggccggatcgcgacgtgcccaccaatcctggtcgccgcggaccgcggcctccgagccggaggcgagatagtcggccctgccgccgccggaatcggtcagcgtgccggcggtggcaccgcctctggcgatcgtcagatcgccggtgacatcgagcccggactggtcgaagaagctcactttcagggcggcggcgtcctgctcgcgcagcgcggtggcggcctgcgtggcggccagtttcgggtcgggggcgcggtccggttccttgcgcaggaaaaggagtccgccggcggcggtcgcggcgatcagcagggccaggaagatcagcagggagtgcaagcgggacgggggccgggagggcgccgcaacggcgggtgcgaccggcgggggaggggccggcaggtgcgccggcgcagcggtgcgctggtgcggcacgaagggcgcgggagcgaccggttcgggagcgcggggtggcgcctgcagaggggtcggatggcgcggctccggcccgatgcgcggcggctcgacacgggccggtggaatgaaggtcggcggggcgaaagcgggcggcggggcggccggaacggaccgggtgggaaccggagtggtggccggcggcggcacgaagatctgcgggtcgggcggcgggggcgtgacggtgggcggtttccgcgggggcgcgggcgaggcccagggactggatcgccgcggaggatcgggcacgggcggcggatccggctcaggcgaaggcgaacgcgaaggcgaagtcgacggcggcggagctcccgcatttctgcgcggcggcgtgtcccacggccccgggtactgcccccgctcgtcctcgtcgtgcgccgaacccatgcatacctcccgtccgcacccggacgggacgatcctagtgaggcgaatcgacagcggacgccgctgtcacatatctggcaccatccgcaagccgtgcggttgaccgtgaaccgggctagggtcttgctcatgggcgttcgcacctggatcgagggctggccggtctaccggcagctcaccggcaccgacccgctgggtcgcggcgccgccgtccagagcccgcgctcgaagagtctcaccgcgcgcaccgagaccgccgactcgatggcccgctccgtctgtccgtattgcgcggtcggctgcggtcagcggatctacgtcaaggacggcgcggtcacccagatcgagggcgacccggacagcccgatctcccagggccgcctctgtccgaagggctcggccagcaagagcctggtcaccagcgaccgccgccagcagaaggtgctctaccgccggccgttcggcacggactgggaggagctcgacctcgacaccgcgatggacatgatcgcggaccggctgctcaaggcgcgcgaggacacctgggaggacaccgacgacgagggccgcccgctgcaccggacgctgggcttttccagcctcggcggcgcgaccctcgacaacgaagagaactacctgatcaagaaactgttcaccgcgatgggcgcattgcagatcgagaatcaggcgcgtatttgacactccgccaccgttcccggtctgggaaccagcttcggccgtggcggggccaccggattccttcaggatctggccaacgccgactgcatcgtcatccagggttccaacatggcggaggcccacccggtgggattccagtacgtggtggaggcgaagaaccgcggcgccaaggtcattcacatcgacccgcgcttcacccggaccagcgcgctggcgcacacctatgtgccggtgcgggccggggcggacatcgccttcctgggcggcgtcatcaactacatcctgagcaacgagaaggacttccgggagtacgtcgtcgcgtacaccaacgcgtccatgatcgtgagcgaggatttccgcgacaccgaggatctggatggtctgttctccggtttcgacccggagaccaaggcctatcaccagggcagctgggcctatgagggccagcaggacgacgactcggtgcaggaccacggcgagtcgcacaccgatcgggagacggcgtccggtctggagcaggaatcgcacggcccgccgatcccggccgacgtgccccgcgatccgacgctgcagcatccgcggtgcgtctatcagattctgaagcgtcattacgcccgctacacccctgaggtggtcgagcgggtctgcggcgtgtcgccggagcagttccgcgaggtctgcgaggcgtggacggcgaattccggccgggaacgcaccaccgcgctggtctattcggtcggctggacccagcacagcgtcggcgtgcagtacatccgcaccggcgcgatcatccagttgctgctgggcaacatgggccggcccggcggcggggtgatggcgctgcgcgggcacgccagcattcagggatcgaccgacatcccgacgctgttcaacctgctgcccggttatctgccgatgccgcaccaccagcagcacgagacgttccggcaatgggtggacgccatccgtcacccggagcagaagggtttctgggcggacgcggaggcctatgcggtcagtctgctcaaggcctattggggcgacgccgccacggccgagaacgattgggggtacgactggctgccccgtctcaccggcgaccacggcacctaccagcaggtcctcgacatgatcgacggcaagatcaagggatatttcctgctcgggcagaaccccgcggtcggctccgcgcacggcagggcgcagcgcctcggcatggccaatctcgactggctggtggtccgcgacctgttcatgatcgagtcggccaccttctggaaggacgggcccgaggtggccaccggcgagatcgtccccggtgaatgcaaaaccgaggtcttcttcctgccggccgcctcgcacgccgagaaggagggcaccttcacccagacccagcgcctcctgcagtggcgggagaaggccctcgacccgccgggcgactgccgctccgagctgtggttcttctaccacctcggccggctcgtccgggagcgactggccggctcgacactgccccgcgaccagggcatcctcaatctcgcctgggattacgacccggacgacggcgagggcgtgctcaaggagatcaacggtttcgacgtcgcgaccggcgagccgctgcccggtttctcggcgctcaaggccgacggttccaccgcctgtggctgctggatctattccggcgtgttcaaggacggggtgaaccaggccgcccgccgcaaatcccggaaagagcaggactgggtggccgccgagtggggctgggcgtggccgatggaccggcgcacgctctacaaccgggcctccgccgacccggacggcaaaccgtggtcggaacgcaagaaatacgtctggtgggatgccgaggccggcgagtggaccggttacgacgtgcccgacttcgagaagacgaaggcgcccgactaccgcccgccggagggtgccaccggcgtcgcggcgatcgccggcgacgacgccttcatcatgcagggcgacggcaaaggctggctgtatgcgccgagcggcctgatcgacggcccgatgcccacgcattacgagccggccgagtcgacggtccacaatccgctctacgcccagcaggccaacccgacccggaaaacgtacgatcggccggacaatcagctcaatcccgtttccgagaccttcccgtacgttttcagcaccagccgcctgaccgagcaccacaccgccggtgggatgagccgccagctggcctacctgtccgagctgcaaccggagatgttcgtcgaggtctccccgcagctcgccgccgagcgtgggctggaccacctgggctgggcgcacatcgtcacggcacgcgccgcgatcgaggcccgggtgctggtcaccgaccggatccggccgctgcgggtggacggccgggtgctgcaccagatctggatgccgtaccactggggcggctccggcctggtcaccggcgactcggcgaacgacctgatcggcatcgtgctggacccgaacgtgctgatccaggagagcaaggtcggcacctgtgacatccagcccggccgccggcccgtcgggcgggaactgctggactacgtcgccgactaccgcaagcgggccgggctgcgaacggagggtcactgaggtggcgggcaacagcctctacgggccgctcgacccggcgccggacgccggctatccggacgcgccgccgcggatggggttcttcaccgacaccagcgtgtgcatcggctgcaaggcgtgcgaggtggcctgcaaggagtggaacggggttccggacgacgggttcaacctgctcgggcactcctacgacaacaccggcgggctgagcgcgaactcgtggcggcacgtggccttcgtcgagcagccggtcgaccaccggaatgtcgacgtcttcgccgaggcggccggcccgcaattcctgggcatgccgagccgggatctgccgggccggaccatggatgcgccgcgcaccgatttccgctggctgatgatgtccaacgtgtgcaagcactgcacccacgccggctgtctggacgtgtgcccgaccggctcgctgttccgcaccgaattcggcaccgtggtggtccaggaggacatctgcaacgggtgcggctactgcgttccggcctgcccgtacggggtgatcgaccagcgccacgacgacggccgcgcgtggaagtgcacgatgtgttacgaccggatcggtgacgggctgaccccggcctgtgccaaggcgtgcccgaccgagtccattcagtacggtgagctggaggaactgcgcggccgggcccgccagcgggtggcgacactgcacgagcagggagtcgccgaggcccggctctacgggcacgatccggacgacggggtcggcggggacggggccttcttcctgcttctcgacgagcccgaggtgtacggtctgccaccggacccgatcgtgcccacccgcgacctgccgaaaatgtggaaacgcgcgggactcgccggtctcgcgatggccgccgccgtcgtcgtgtcattcctggggggacgcccgtgagccgtggaggcgaccggccgatggtgccgaaggccgagttccggtcctactacggccgaccgatcgtgcggccggcggtgtggcggcacgacatcgcggcctacctgttcaccggcgggctcgccgccggatcggcgatgctggccgccggcggcgacgccaccggccgccccgccctgcgccgcgccggccgggcgaccgcgctcgctagctagctagtgccgccatggccgccgcacccacgccgcagcagcccggctggcccgccccgcagcagggcggccccggttggcccgccccgcaacagggcggctggcagccccccgcccgccccagcccggctggccgcagcagccggtcccgctacagggttggccgcagcagccggtcccgccacagggttggccgcagcagccggtcccgccgcaggccggctggccgcagcagccggtcccgcagcccggtggctggcagccgcccgccgtcctgctcggtcccccggccccgccccgcgagccggccaaaaccgaccgcctggccgccgccctgggcaacgcctcgttcctgagcctcggctacttcctgatgcgccgcaccgtcctcggcgtactcaccctgctggccagcctgatcctgctgctcgggatcgtcccggccgtccacaccggatggatcgagatcgtcgccgtcctctggtggatcgcgatgatcgtgcatggctggttcctggcccgcggtccggtcgaaccggccacccgcacccgccagcggatcgtcgggatcgccgccgcggcggtcgtcctgctgctcctgggcgggctccgggtgcaggccgccaccatcggctcggcggtcgacgacgcgaaagccgccggtgactgcggcggtgcggtcagcaaactcgacaagctgtggttcggtctgcgcgtcgccgacggcccgatggccgccgagggtgacgacacggtcgaagcgtgccggcagctcaacgaggccgacgaaaccctgaccgggatgctcaccgccccgagcgccaccggcctgaccgccggattcgaccagatcaacacggtgctgacccggttcccggggcacgagaagatggccgacgcggtgctcgacgggttcctcggcaagctgccgctgtcggacgcgtgcggcaccgccacgatcaccagctggctggccaagcggccgaagacgaacaacaccctggaccgctcggccgaggtggtcgccaagcacgagccggccgccctggccggctgcggcgacacctacctcaacggccagcagtgggagtcggcgaaggtcgtctaccagcagctgatcgacacgtacccgaccgacgtgaacaagccgaaggccgaggaggggatcgccaaggcggacctggccatcgagttcgacgcgttcaaggacgcgaccgacagcgtctccgggaactactgcgacaccccggtcaagtacagcgccgccaaggcgtacggcaaaggtgtcaaccgggccatggtcttcggcaacgacaccgaggcgaagcggctgccgggcggctggaagaccaccgacccgaccgtcgccaacctggtcctctgcgtcagcggcgactcgcagggtgcggcggtgcgcagctgcgactacggctcggccggccagcaccgggtgaccttccacaaggtcaaggtcacggtgcggggttacgaggtgcgcagcggcaagcagatcttcagcaagaccctgcagttcagcggtacgtcatgcccgcaccggatcgagtacatgaccacgctcggggtcgacctcggcccgccgcggcacatggatgtcaaggtcgacgccaacgacgtacaggcgcaattcaagcccttgatcgtgaagtagggaatccgggggcccttccgcgggagggccccggatgtcatcggacgaccacggtgaccccgtcctcgggcggcagcagctcaccgatgatcggccaaccgggcagctcgccggcgaccagcagcccgcccgaggtctgcgcgtcggcgagcagcagcaactcgtcctcggagacccccgcggtgtccgcgtgcggccgcacccagtccaggttgcgccgggtgccgccgctgacgaatccgccggccagcgcctcccgcgccccgtccagataggggaccgccgccgggtcgatccgcgcggtcacgccgctggcccgggccagcttgtgcaggtgaccgaggagtccgaaaccggtcacatcggtggcgcacaccaccccggcggccagcgccgcctccgacgccgcccgattcagggtggtcatcgcggcgaccgcctgcgggaagacctcaccggtctgcttgtgccgggagttgagcacacccaccccgagcggcttcgtcaacgtcagcgggatgccgggccgccccgcgtcgttgcgcatcagccggtccgggtcggcgaccccggtcaccgccatgccgtacttcggctccggatcgtcgacgctgtgcccgccggccacgtgacagccggcctgccgggccacgtccaggccgccccgcagcacctcggtgaccagctccagcggcagcacgtcccgcggccagcccagcagattcaccgccacgaccgggcggccacccatcgcatagacgtcggacagcgcgttcgccgcggcgatccggccccagtcgtacgcgtcgtcgaccaccggcgtgaagaagtcggccgtcgccaccaccgcggtcccggccgcgatccgcaccaccgcggcgtcgtcaccgtcgtccagaccgaccagcaggtcgccgcccgcctgctgatcgggaccggtcagcccggccacgatctgctccagctcgccgggcgggatcttgcaggcacagccaccaccgtgcgcgtactgcgtcaaccgaacagtcatcctggaactgtggcataccgggcgatcggctaccgtgatcaccggaggcgttcaggttgctggtgctcctcgcggtcttcaacaccgacgtgacccggactccgggtcaggcgggttcgattcccgtccgcctccgccaccagcccgccgagcgaagttgcaggcaccccgacgaggtcgatcacgatccggtagttgacctggatgctcgacttcggtctccacgtcgtcgacttcgcctcgcaaccgctggtcttcgagggggcccacggcccggcctggatggggcaggttctcctcaacccggtcaagccactgccgaaggtccttgccggtcaaccgcagccaatcgaaaggcatgcatgtccggcatctctcaatccggtccgaaccgtcgtgaccggcgtcgcaacgccaagctcaccccggcgcatggtcgccgccgcggtgcttccgatgatcgcggtgccggccttcaggagccaggtggcgttcgccgccggttcgacccctccggtctactcgctggccgccaccgtcgcccccgccccgatgaccctcgcggactgcaacgaccccacctgcatcgtcgcgccggccccgagcggcaacgacgactaccccacgctcaacaacctcctcctgcttgcggccagccggacggtccccgccgtgctggacgccgacaacaacgtcgtgacgccggcgacgaccgccacggtgttcctcggcgagggcacctaccgcgtcggcaaggtcctgaaactgccggcgaacgtcaacctgcgcggccggggcatcaccgcgaccacggtctcgatgatcaccgcgaacaacgtcaacttcacctacgcgtccatcatcagctgggacttcaaccaccagatcgccggagccaccagcaacctggtctccgacctgaccgtcaacggcaactgccgggagggcgccggccagccggtgccgtcggacatgccgggccgccccggcgagttctgtgacttccgcggagcggacggcaaggccgcctcgacgaactcgggcggcggtgtctcggtcggcgacaactggaccgtccgccaggtgcggttcaccaacctcgagtacttcaaggtctgggtcggtaacggcgtcacgaatgtgcgcatcgtcgacaaccggttcgacaactggggcggcgccgagtcgggcgacgaggacaacgtcggcggcggcagccggaacgacggcgtgatcgtcgagtacaaccagttcgacaagacgatccgcggcaacagcttcgacttcaccaacgccatccgtacgaccgtgcgcaacaatgtcgtccgctcggacggcacgatcgccacggcgcgtaaggacacgtcgctctacggcaacatgtacttcgagggcatccagcaggccaccgtcaccgacaacgtgctgtggggcgcgcagatcgccctcaaatccaacagcctgtacgcgcacagcggcgagaacagggacatcaccgacccgcgtgactcgatcgtctcgggcaaccggatcagctactccggcgagaccggcatcagcgtcacctacgacgactacaaggacggcccgaacgcgtccaacctcggacagcccggctcctggaccgacaagagcgcgcccacggacgcgttccatgtcgtgcgcccgggcggtaacaacgtcgtccgcgacaacgtgatcgagtacacgggccggtccggcatcatggtcaacggctcgtatgccagcgccaagaacgcggccgacaccatcaccggcaacgtcatccacaacgccggctggggcggctccaccgtctacgacagcggcgcgggctacttcgacaccgcgggcatcggcctgtcgatcggtgtcggcgaccaggtctacggcaacacgatcgaggactaccccgccaagaagaccacgtggtacgggatcgacctcggcgcccgtcgcgcgtcgaccagcccgaccggtaccgtcctgacggggccggccggcgaggtcaacaccgtcaccaacgtcatcggcaccgcttaccacgaccagaccaggatctccgaggcggtcaccaacctgtcggccggcggcaaggtcctcaactgggatgaggcgtacccgctggacgggcgcccgatccggggctaccggatctaccgggacggcaacgtcgtcggtgacctgccgatcggcagcgtctccatcccgaacaacatcatgaccgccgacgagtccaacttcgagaacgcgtccgccggcacggccggctgggtcgccggcacccgcacgacgctcgcccgggtcgccggcaacagctcgcgcggcaccgcctcgatgacgctgacctccagcggcacgggtgaggtcagcttctccggccgcaagatcaacgtgacgcccggtcaggtctacacctcggtcctgtcggcccgggcgatgtccaccgcggccgccggcaagcaggtccgcgccggcgtgaagatcaccttcgcgaacggcacgacccagaaatgggcgaccaacaacaagaccgccatcgactcctacgccaactggatcaccagttactacacgttctccgtgccggccgacgcggtgtcggtggagccctggtacctgatcgagggcacggtcgccggcgacgcccacatggtcgaccgtctcggcctggtcgcgggcacccgcaccgagcagttcaccgaggccaacggcccggccaacgcggtctaccacgtcgtctcgtacaccgcggacgacaactccatgccgcagtcggtggtcgtcccctgaccagccgcccggtgctatgaccccaccccccccgggagcctgtctcccgggggttttctcagggtggccgccgccccgccgatggagggaacagccggcatcgcggaggaagggaagttccggccgtcggccgtgagtccctacccggaggaaacctgatgacccaagccgtcacggcccccgacccggtccgtgccccggcgcggcccgggccgaaccgggcgctcaacgcgctccgcgccgtcgcggcggttctcgtggtcgtctaccacctgcgccagctgctgttcgtcgacgcggccgacgcgggtgacggcctgtccacccggctgctgtacgccgtcacgaacatgggtcccgcggctgtcgtggtcttcttcgtgctcagcggttactgggtgggcggcagcgtcttctccgggttccggcgcgaccgcttccggtgggcgtcctacgcgaccgcccggctcagccgactgtggatcgtgctgatcccggccgtcgccctcaccacgatcctggaccgggtgggcctcgccctgctctccgggacctccatctacctcggcgacccggcctatcaccacacggttcccgccgatggactcgccgaacggctgaccgccggcaccgcgctgggcaacgtgttcttcctccagacgatggcggtgcccacctatggcaccaacgcctcgctgtggtcgttggcctatgaggcggtcttctacgccgtgctgccgctcgcgttgtatgcctggcgtggccgcggcggcatcggcaaacgggcgctcagcctggtgctgctgctcgggctctgcgccctcgccgggccggccgtcctcaagtatctcccggtgtggttgatgggagcggtcgtcgccctctaccgcgagccggtccggaactggttgcaggcccgctcggcacactggctggcctggtcgcgggccggcgcgtcggccgggctgacggccggcctgtggctggcgcaggccagctaccgcagcgtgaacgtgttgctgctggccaccgcgacgaccgtgctgctggcgctgctcgtcgaggacgtcggctggaccggagtgcccggccgggtgctcggcggcctgtccgattacgcggactcgtcctactccctctatgccatccatcttccggtcgccgcgatgacggctgcgctgctcaccccccacgtggccgcccgttgggcgcccactgcgacacactggctggccctggccggcatctgcgcggtgctgaccgcgatcggctgggccttcgcacacgccaccgaacggcacaccgaccgggtgcgccgcatcgcggacacgctcatcgcgtcggtcgcggcgcgtacccgtacctgaaacgggtcggcatccccgccatgtccccctgcatcggggtgctgctcgcccaagaagagcccccgcgagatcgccgtcggggcggccctgctgtccgccgtcaccgcgcaactcgcgctcggcgcccttacctgccggcccgcgttgcccggcggcccgtgttgcctggcggcccgtgttgcctggcggcccgtgttgcctggcggcccgtgttgcccggcggcccgtgttgcccggcggtccgggatgtcttctggcggcgaccggcggccggcagggtgaagtcggcggtcaggcgtcccgcggcgctgtcactcgacggaccatcggcgcgccgggaagtcgaacacccagacggcctgccgcagcgccggatagccgaggaccagatcgacccggtccagacccgccggcatgtcataggcgacggcgcgatgcggcgcgaacatgcggccaccgatccgggccgccgccatccagtatgccgccccctcgaccgtggcgccggtggcgtcgatgccggacgaggtaccggcggagcggaacagctcgggatggcgggccacgaaggtcttgccgacaacggtgatcccggccccgctgtcccagcacgcccgcgcggtgacgccgggccactcgacatccacgagaatgtgaccccgggcgccgcggtcgagcggccggcgggtcggcagggtgccggtcggtgccggctgccagctcccgcggtcgaagtcgaaccggcccgggtatgcgccgatcgcgtccatgccgagcaggttccgcaggtcgggatgaccggtgtcggtgctgctcacctccaggccggtccaggacagcggcccgacggtcagctcgggcaggatcaggagatccgcggtgctcgtgccgaccaggccggacgactgctgactgccccgccgcggcagccgggccagctccgcatcggcgacgatggacgtccgccccgcaccggtgtccaggatgaaccgatacggccggccggcgatcgtgccgtcgaccaggacggcggcgcagccgggctcgtcccggtcgggttccacgatcagcggcacaccatccatcgagccagattaggccccctcggccgcccgagccagggtgcgccggggcgccgatcgcggagagccgcggcgccgagagagggccggccggacgatgggcgcggcaccgagacagggcacggcggcgacgggcgtggcaccgatacggcggaacggggcggtgatcgggaggaccgccggccgggctcggcatccaccggagcggctcgcgggcgtggcacgatcggggtggaagatcgcagtacggtcgagaggcagagcttgtggatccgcggcggcagataccccgtaccgacgccgtgctcgaagatcctcgcctggtggccgcggccgtccggctcggccgggagccggtgaaagcggcggtccgggcggcccagcagcgggtgcgggacggcgaactggacgcggcggacgtcgccggggccgcggtggcggcgctgccggagaccgcgggcgggctgcggacggtcctcaacgcgaccggcgtcgtgctgcacaccaacctggggcgggcgccgctgtccgcggcggcggtcgaggcggtcgtcgcggccagcggacacaccgatgtcgagctggatctggccaccgggcggcgggcacggcgcggacggggtgcgctggcgtcgctggcggcggcggtgccgcgggccggggcggtgcacgtggtcaacaacggggcggcggcgctggtgctggcggcgacggcgctggccgcgtgccgggagatcgtggtcagccggggggagatggtggagatcggggacggcttccggctgccggatctcctggagtcgaccggggcgcggctgcgggaggtgggcaccaccaaccggacctcggccgccgactatgcggcggtggtcgggccgcagaccgggttcatcctcaaggtgcatccgtcgaatttcgtggtgcgcggcttcaccagcgccgtcgcggtcggtgcgctgaccgggttcggggtgccggtggtggcggacatcgggtcggggctgctcgcgccggatccgctgctgcccgacgagccggatgcggacggcacgctgcgcgccggcgccgatctggtgatcgccagcggggacaaactgctcggcggcccgcaggccgggctgctgctcggcgacgctgacctcgtcgaacgcctgcgccggcacccgctggcacgcgccctgcgagtggacaaactgacgctggccgccctgcgggcgaccgtcgccggtccggtcacaccgacctgggccgcgctccgctacgacccggacgaactgcgggaccgcaccggacgcctggcggcggccctggacggcatcccggtccgggtggtcccgtcggtcgcggtcgtcggcggcggcggcgccccggagcttcaggtcccgtcgtggtcactgtcgttgccgatttcgtacgcggtgagcctgcgtgtcgccacccctgcgatcgtcggacgggtggagcacggccgcctcctgctcgacctgcggtgcgtgccacccgctgcggacccgcaggtcgccgccgcgatcagagccgtgtcatgcgagtaaccgccccggatccggggcacacaccggccgcgccgagcgggtgaccgccgtcgcggtgaccgcttcgccggtgatcgtggtgaccgcggccgtcggccggtgcggtgcgggcggcgtggtgggtgcgggttcgggtggccgtggtgaccgcggccgtggccgatggtgcggtgcgggcggcgtggtgggtgcgggttcgggtggccgtggccgtggccgtggccgatgttgcggtgcgggtggcctggtgggtgggtgggtgcgggtggtcgtggtgagcggagtggtggcgtgcgggtagtcgcgaccgcgggacatgtggatcacggaaagtcgacgctggtgcgggcgttgaccgggatggaaccggaccggtgggccgaggagcggcgccgggggatgacgatcgacctggggttcgcctggacgatgctgggttccgggacggtcgtggcgttcgtggacgtgccggggcatgagcggttcgtgccgaacatgctggccggggtggggccggtgccggccgcgatgatcgtggtggccgccgacgaggggtggcggcagcagtcggcggagcacctggccgctctggacgcgctcggggtgcgccacgggctgctcgtggtgacccggtcggacctggccgacccgggtgcggcgacggcggtggcacgggccgagatcgcggcgacctcgctgggcgcggtggaggcggtgccggtcagcgcggtgaccggtgccgggcttcccgagctgcgggcggccctggaccggctggtgggcgggctgccggagccggatgccgacgcggcggtgcggctgtggatcgaccggtcgttcacgatccgcggggcggggaccgtggtgaccggcacgctcggcgcgggcaccctgcgggccggggacgagctcgcgctgaccggtatggatcggccggtgcgggtgcgcgggctgcagagcctgggtgagccgcgcgccgcggtcgccgcggtcgcccgggtggcggtcaacctgcgcggcgtggagaaggacgcggtggcgcgcggggcggcgctgctgaccccgggccggttccgcctgaccgacctgatcgacgtccgactgcacggtgcggcattcccgacgagagcgatgccacaaccggtcccgggagagccgccggcgagcgtgacgccgccggtggacgcgcaggcgggccggacaggtttgtcggcctagctagctagtgcgggtgcgcccgctcggggtggacaccgtgcggctgcgactcgggcgggcgctgccgttgcggatcggggatcgggcgctgctgcgggatccggggcggcatctggtgatcgccggggtgaccgtgctggacgtggcgccgccggcggtgcggcggcgggcggcccgggtggccgagctggccaccatggacggtcgtcccgacctggccggggagctgcggcggcggttgctggtccgcgggtccgtgctgctgggcatgggtgtcccgccgcggtcaccggtggcgggggactggtatgcggacccggcgcactgggcggcgctgcgggcgcggctgcgggacgaggtcggtgactacgtcgcggggaatccgctggagccgggcatcccgatcgacgatctgcggcaccggctcgggctgcccgaccgggtcctggtcgaggccctggtggagccgccgctgacgatccgcggcggccgggtgggcgccgggccgcgggaactgccggccgcgctgctggcggccctggagaaggctttcgaccgggagcggccgttcaccgccccggaggcccaccggctgagcgacctcgggctgggcgcccggcagctggccgccgcggtccgcctcgggctgctggtccagttggcgccggccgtggtgctgccggccggcgcgccggaacgggccgcggacgtgctgacggcgatcccgcagccgttcacgctcagcgaggcgcggcgggcgctggacaccagccgccgggtcgcggtgccgctgctcgaactgctggaccggaccggtgtgacgcggcggctggcggacgaccgtcgtacggtcaattgatgatcttggtggacgaaccgcgcgccgcctcgacggtgtagcgccggccggcttcggcgagtttgtcgagggacgcctcgatcaggtcgatgccgagcacgtcggcgagccgcaccaggtagatggtgacgtcgccgatctcggcgcgcacccgtggaccgagatccgggtcgctcatcaccgcggcggactgctccggggtcagccactgcagctcggcgagcagctcgccgacctcgcccgcgagagccatcgccagattcttcggcgtgtggaagggctgccactcgcgttcggcggcgaaggcgcgcacccgcgcggtcacatcatccagattcggcacccggccagtctggcaggccacccggcgacgtgattcccggtcggcgtaccgcgatggacgatgatcgggcgcggacgcggctcgccgccggtgatcgatggtgacctttagtaggcttccccggtcaccggcagcgcagtgattcgagggaatggcgagatgaacgacgggttccacgcggaccgtacgcaggagatgttcctcgcggtggcgccgccggtgccgccgcagaccggcggggccgacgtcatcgaggtggcggcgtatcgcggcgacaccgtcttcgagcgcgaggtgatcgagaagctggcggcggcggccgcgcggtcggtgccgggcgtggccgagctcggcggagacgtcgcgcggttcttcaacgcggtgctcgacagggtgggcctggacaaggtgggtgacgccacccgcggggtgcacgcccgggtggacggcatcgacgtcgacatcaccgtggtgctctgcctgcgggccggcgaggtggtgtcggaggtgaccagcgaggtgcgcgcccgggtgatcgaggcggtggagaagtacggggtgcaggtcaacaactgcacggtcaaagtggacgacatcctgatgccggagtgatccggaacggcgggggctcgccggcctgccggacgcggtgcggacggtggtctgcggcacacccacatgccgttcgtgcgggacgacctgtgcgaggcggcggcgatggcggcgttcggcccgcgggccgggcggcgatcttccgggccggtgtcggatccggggtgagtcgttcgtagtggtgacgacggtgcccgccggcacggaggaagaggggttcgacgatgacgcggtatctgatctcgttcaacgacggtgcgatggaccacatcgcccgcgcggagctcggcgacgtggccgaggccacccacgcggtggcgcaggaggcgatggacgccggggtctgggtgttcggcgccgggctggagcgccagcgggccagcgtggtggccaccgacggggtcgtcaccgacgggccgtacccggagacgaaagaggtgatcggcggcttcgctgtcgtcgaggtggcgacgcgggaggaggcgctggcgtgggcggcgcgcatcgcggctgcctgccggtgcgcgcaggaggtgcgggaagtgctgccggacgcggtgcaggacgagatgttccgccgggccggccggaaccggtgaggccgaccggcccggccgtgggtcagtaggtggggcagaggcgctcgcggaccaccttgatgatccgggcagcgttggcctgcggggtggtgaaccgctggctggccacggtggcccagtccttctgcgggcgggtcttgaggtcgcggcactggtcacggccacggttcaccaggacctccgggtcgtgggcggcgaccagcttcgggtcgatgctcttcaggtcggcgacgtaggcctcggcggccttcgtgtccggcttcggcgggaaacccagctgcgcctccatgctggcccgcaggtccggctgcgagtgcacggccggctgggagttctgcgcggccggcgcgaccgtcttgtcggtgtcgtcgccggatccaccggagcatccggcggcgagacaggcggcggcgagggcggcggcgatggcaagcgtgcgagacatgcccggctcaacgacaccaccgtgccgcggggaacggcccggccggtcagcggtcgtactcgaagatcttcgcggcgaggtcggccatcacctcggtggcgccggcgccgatgccgaggatccggatgtcgcggtagtgacgttcgacctcggactcgcgcaggtaacccatgccgccgtgcagctggaccgcctcgtcgacgacgtacttgccggcgtcgacggcggcgttcttggccaggcacgcctcgccgggaacccagtcgccggcggcgtggcgggcggcgacccggcgggtgaaggtgcgggccagttcgatccgctggcgcatctcgaccagtttgtggcggaccacctggcggctgatcaacggccgtccgaacgtctcccgggcgcgcacctggacgagcgtgagatccaggcagcgctgcgccaccgagtacgcgtgcaccgccgtgatgatccgttccgggacgaagacctgggcgatcagcgggaaaccgccgtgctcggcgccgatcaggttggcggccgggacgcggcagtcggcgaaggacagctcggccgtgtcggagcagtgccagcccatcttgtcgagcttgcgggacaccgtgaaaccgggtgtgccgcgttcgacgaccagcaggctgatcccggcggcgccggggccaccggtgcggaccgcggtggtcacgaaatcggcccgggtgcccgaggtgatgaacatcttggccccgttgaccacatagtcgtcgccgtcgcggaccgcggtggtccgcaacgcgccgacgtcggaaccggcgtccggctcggtcacgcccagcgagccgatcttctgcccggccagcgccggccggacgaaacggtcgatcagcgaaggatcgccggccgcgatcatgtgggggagcgcgatgccgtgcgtgaacagcgccgcgtgcgcgccggacgagccgcccgcctcgaggaacgcctcggtcgccaccaccatgtcgacggtgtcgccaccgtccccgccggcctcctcggggaacccgacgccgtacaggccggctttcgcggcgccggcgtgcagctcccgggggatctcgccggcccgctcccaggcatcgaggaaaggcacgacctcccgtcgtacgaacgtcgccatcgcctcgcgcagcgtgccgcgttccggagtctcgaacggatcggcgtacatgatcactgtcctctcgtggacgaagcacggccgaggagagtcgccgcggcccgtttccaccgccggatcggcagctcaccggcgaccgggtcgccgctgacgatcccggtcatcagcagcccggtcatcacctcgaaggtcatctgcgtcacgcccggcacccgcgggtcgtcgccgagcaccgcgaccgcccgctcgtgcagcaccccgaagatctccttctccaccggcagcagcgcggcccgcaactcctcgtcggtgcgggccgcggcccacagttcgagcgcggcccagaacatcggcgccgagaaggagtgccacaccgcgtcgatgtaggcgtccagcccgtcgccggtgacctcggccagctcggcggtcagcgcgtcgagccggcgccgggccacgtgctggaccgacgcgaccagcaggtccaccttggtcgggaagtggtgcagcagggtgccgcggggcactccggcccgggcctggacctcggccgtggtcgtctccgcgtagccccgctcgaccagggactggcaggtggcctccaggatccgggtccgggtggccgcgctgcgctgggcctgggtacgcctcacggcatttaccgtacggcctgacggtttgcgaaagaaagtcttgtcgtgacgcgcgtcactgctttaccgtcacgccagactgttcaaggggtgtcgatgcgcttccgccgccgttccgtgcccgagaccttgcccgtcgtcgtcccgccgcgccggctgagccgtccctgggcactgtccgtgacggtcccggccaccccggagcgcgtccacgcctacctgacgcacgccgccacgatggccgactggatggtcatgcacaccggctggccggccgatccgcccggcgtggtccacggcgggagccgcttccgtcagcgggtcaggctgatgggcacaccggtcgaggtgcgctggacggtgcgggacgccgagcgtccgcggacgctgtggctggacggcaccggtccgatggggatcgaggtcggcgtctatctctcgctggcggcgggggagggcggcacggtggtgcggctcgacggtggggtgcagggcggccccacggacgggccgctgggcgcgatggtcgcccgcagcctcaccgacgccctgcgcacctcactgcggcgactgaccgccgtcgacctcaccgcgaccggcccggtcatcggcggcccggacgatgccgcgtccgggcgcgtccgcccaccggagaaatccggaaaaatccgacatgagcgtacggggatcgacctcgacccgtggaccccggtcatcgtcggcgccggccaggtcagcgaccgttccagcaccgacgacccggtcaccctcgcggtccgcgccctgcgcgaggccgccaccgacgccggccgaccaggcctgctgccgatggccgacaccatcggctgggtcgccagcgtctcctggcagtacctctccgccggcgccctgatcgccgaagccgtcggcgccacccccacccacaccgtccagaccagcctgttcggcggtgacggcccgctgcgcctgctcaacgacatcgccgccgccatcacccgcggcgagaccagcatcgccctgctcgccggcgccgaatccgccgccaccgcggccgccgccgatcgcgccggccacccgctgaactggccccgacagccggacggcaccgcgcccacccgcatcctcggctccgaccgggagcccaacaacaccccggagaccgacgccggcctggtctccccgctgcacctgtacgccctgatcgagaacgccctgcgcgcccgccacggccgcaccccgcagcagcaccaggcggtgatcaccgagttgtggtcccgcttcgccgacgtcgccgccaccaacccgtacgcctggcttcccgggccccgcaccccggccgacctcgccacccccggccccgtgaaccgcccggtgtgccatccctacaccaagctgctcaccgcgaatttgcaggtcaaccaggcgagcggcctgatcgtgtgttccgtgcgggcagcgaccgaggcgggcatcccgcaggaccggtgggtcttcccgcacgccggcgcccacgcgagcgacgcatggttcgtcaccgaacgcgacgacctcaccgcctccccggcgatcggcgcgatcggccgggccatcctggcccacaccgggacgacgatcaacgacatcaggcacatcgacctgtacgcgtgtttcccgtccgccgtgcagatcgccgccgccgagctcggcctgccgctcgacgacccggcccgcccgctgaccgtgacgggtgggctgaccttcgcgggcggcccgggcaacaactatgccgggcactcggtcgccaccctggtgtcccggctgcgcgccgacccggacgggttcggcctggccaccgcgctcggctggtatctcaccaagcacgccgccaccatcctgtccgcgcatccgccgcgcgccgggttccgggacatcgacgcgggcctgcgcctgccccgggcactgcgcccggccgcgtcctcggggtcgggcggcaccctggaggcctacaccgtcacctatcaccgggacggcaccccggccaccggcatcgtcacggagctcggcccggacgggacgcgcatcgtccgtaccgccgatcccgcctctcttctcgacggtgacccgctgcgacccttcccccgaccggccgccctgaccccggtcgaggtggcctggcacggcccggtgacggtgatccggctcaaccgccccgaggcccgcaacgtcgtcgatccgctcaccgcccgggccctgcaacgcgcgatcggcgacttcgaagccgatccggacgcccgggtcgcggtgctcaccggcaccggcccgacgttctgcgccggcacggacccggagacggcggccctcgggccgatcggcaagccgctgatcgccgcggtcgagggggtcgccgtggccggcgggttcgccctcgccctggccgccgacctgatcgtggccgccgacgacgcgctgttcggcctccccgaggtgaccgaggggctggtcgcggccggactgacccggctggcccgccggttgccccgggccgtcgcactggagttggcgctgaccggtgagccgatgccggcccggcgcctgcacgacctcgggctggtcaaccggatcaccgcgcccggcaaggcgtacggccaagcaatcgatctagcggtctcgatcgccgcccacccggcggcggcggtgctgctctcccagcgtgccgtcgccgagtgcggcggcgacgacctgcggcggaagggctgacctgtgagcgtcctggagaatgtgcacgcggtgctgcggatgcaccagatcggcatcgtgaacctgctccgccccgatcgtctggccggcgccgcggtccgcaacgcccggctcggcccgcaagccgccctgatcatgaaggccgccgccgagcacccgcacgccccggcgctcaccgacgagcgcggcaccctgaactaccggcagctggacgagcagtccaatgcgctggcccgcgccctgaccgagctgcgcctgccgccccgctcggtgatcggcgtcgtcgcccgtgaccaccgcggcctggtcctgacgatcagcgccgcggcccgggccggcctgcgcctcgcgctgatgaacaccgggctcgccccgcagcagttcgccgaggtggtggcccgggagaacgtccgcgccgtgctctacgacagcgagttcgcggccctcgccgacgccgtgccggacaccgtcccgcgctatctgacctgggccgacgagggcgccgcggaccggaccatcgacatgctgatcgccgggcagccgaccaccccgctgccgctgccggaccgcccggccggcttcatcatcctgaccagcggcaccaccggcctgcccaagggcgccccgcggaccagggtgtcgccgctggccagcgcgctgatcgcggaccggatcccgttcccgcggcagggcgcgatcgtggtcgcctcgccgctgttccacagcaccggcttcggcgcctggaccgtcgggctcgccctcgccgaccacgccgtcctgctgcgccgcttcgacgccgaacgcatcctgcgcgcgatcgccgaccaccgggcgtcgatgctggtcgcggtcccgacgatgctcacccggattctcgctctgggtccggagacgatcgcccggtacgacacgacgtcgctgcgcacggtcttcgtcgcggggtcaccgctcgcgccggagctgaccaaccgcttccaggacacgttcggggaggtggtctacaacgtgtacggctccaccgaggtggccgtggcgtcggtcgcccagcccgccgagtcgcgccgcgcgccgggcacggtgggccggccgccggtcaccgtgcgcgtcgccctctacgacgacgaggggacgcgggtcacccgcccgcacgtcaccgcgcgggtgttcgtgcggaccgggatcccgttcgagggctacaccgacgggcggcacaagcaggtcatcgacggccacatggccaccggcgaccgcgggcacctcgacgagaacgggctgctctacatcgacggccgggacgacgacatgatcatctcgggtggcgagaacgtctacccggtcgaggtggagaacctgctcaccgaacgcgacgacgtgatcgaggccgcagtgatcggcgtggacgatccggagttcggcacgcggctgcgcgcctacatcgtccccgccgagcactccgcgcgcgacccccaggagatccgcgactacgtcaaggcgctgctcgcccggtacaaggtgccccgggacgtcgtcttcatcgacgaactgccccgcaacgccaccggaaaggtgctgcgccgcctactgcagtagcgtctcggccggcccggcgctcccggccggatactccaccagcggcacctgaccgtcccgccatgccgcggtcaccggctcgacgatccgccagcactgctcggccgtgtcaccgcgcaccgacagcagcgggtcgtcgtcgaaaacgccgtgcagcacctcgccgtacggtggcaggtcgcccgggccgaagtcggtctccagcgtcaccgggtccagttcgaacgggtcgccgggcccgttcacggtgaagtccagcgcgaaccggtccggtccgaaaccgatccgcagccggttcggccgctccggtccgtgcagcccggtcggcagccgcggcggctccttgaaggtgatgatcgcctccttgcggctgctgcccaccgccttgcccgaccgcaggcggaacggcaccccggcccaccgccaggtgtccaccgccagcaccagctcggccagcgtctcggtctcccgcgacggatccaccccggcctcgtcggcgtacgccggaagctgccggccgtccagatccccggccgtgtaccgggcccgcaggctcgccgtcttcggatcgccgccccacagccgggtcgcccgcagcgcctccgcggtccggtcccggaaatcctgcggatccagcgacgtcggcggctccatgctgagcagcgccagaatctgcagcagatgactctggatcatgtcagcgagcgcgcccgcccggtcgtagtaaccggcgcggttctccaggcccagattctcgtcgaagatgatgtcgacgctctccacgtgctccgagccgagcagcggctcgaagatccggttcgcgaatcgcagaccgagaatgttcagcacggtcgacttgccgaggaagtggtccacccggtggatccgctcctccggaaccagccgggtcagcagccggttcagcgccgccgccgagttcgcaccggtcccgaacggcttctccagcaccagccgggtgccgtccggaaggtccacgtcgagcagcgcctcgcacgccttcgcggtcaccgcgggcggcagcgcgaagaagatcaccgggcggtcggcgccctccagcagaccccgcagatcctcggaccgggtcacgtcggcccgcacataccgggtcccgtcgatgaccgtcttaccggccgggctctccgggaacgctccggtcacccgctcccgccacttctgcgcgtcccagtcgtccatcccggcaccgatcagcgtcagcggcggcgcctcaccggccgcgaccagtgcgccgagacccggcagcaggaggcgtccggtcaggtcgccggatgccccgaggatcaccagcgtctgcgcgcccttgtccaccgggcccgctttctcgggtgccgccggtccagctttctccgccgccgccgcgtccgccttctcggtcaccgcccccgcgtccgtcgcgtccgccgcgtccgtctttccggtcgccgccgcgcccgtcgcgtccgtctttccggtcgccgccgcatccgtcctctccggcgcgtgcgcactgtccgccgcgctggccttgtccgccgaggagccgtcatcactcatgcgtcccgcatgccccaaaacccccaagatcaaaacctgcttgccgcggtacgccgtgaccggccccatcgatccccccgccccggcacgcccggcgaaccccgcccgccgggcccaccgccccgcccgcccaccccagcgctcggcccgccctgaccggccgctcccgtccgcgatttcggcggcccgcgtaccgccccggcgggttgcggttcaagcttgcgaggccccacggaggcgacgagacaccgtccccgaccgccggaaccgcgcgtggcggaaggatcgatctgccggggtgctccccgtaccatggcgctgtgccatcagacttcgcgctcaagtccatgaacgccgtgcatcgagctctcctgcgggtcagtggagggcggttcggttaccgggtcatcggcatgcccgtcctcgaactggtcaccgtcggccgccgcagcggcgtaccccgcgcggtgatgctcacctcgccgatccgcgacggcgaggcgcatgtcgtcgtcgcctcccgcggcggcgacgaccgtcacccggcctggttcctcaacctccgagaccggccgcaggtggaggtcgccttccagggcgggccacgccggccgatgatcgccgccgtcgcgacgcccgaggagcgggcccggctgtggccggagatcatcgcgggcttccccaactacgccggctaccagcggcgcaccgaacgtgagattccgctggtcctgctccatcccgtgcgctgagccgcgggtccgccgaggctgtacccgacgacttcacaagcccgcggtacccgcgtcagcgcaggccggtcgttggcgggcaccccgatgctccagccgcgtcggcctccggattctcctgccgccgcgccctgtcacaggcaggtgggtgtgctcgggggctcttctccgttccgccggcagagggataccgcatcgtcgaactgaccggggaacgccgggtctgattgccgccagacacgtacgcacgtgacgacgacagtgtggacatggcagaaaatcttgacggcagagtggcgttggtgatcggcgggagccggggcatcggcgccggcgtggcggcgcggctggccgaggacggcgctgatgtggtgctgacgttccagcatcgtgacgatcaggccgcggtcgtggtgaaacagatcgagggattcggccgccgcggtatggcgctgcaggtgaacagcgccgacccggaggcggtgaccagtgcggtcgaccgggcggccgagcagttcgggcggctggatgttctggtcaacaacgcggcggtgttcttcgtcgggccggtggaggatttcggtcgcgaggagttcgaccgcatgatcgcggtcaacgtgcgggcgccgttcctcgcggcgaaggccgcggccaggcatatgggtgacggcggacggatcatcacgatcggaagcaacatggtggagcgcacggtcttcccgggcttctcgctgtactcgatgagcaagaccgcactggtaggactgacgaagggcctcagccgggacctcggcccccgcggtatcaccgtcaacctgctcaatcccggccccatcgacaccgacatgaaccccgctgacgggccggcctcggccacgatcatcggtttcaccgccctgggccgttatggaacacccgccgagatcgcgacggcggtcgcctatctcgcaggtgacggtgctcggtacgtcaccggtgcggtgatcaacgtcgacggcggtttctcggtctgacgcccgggtctgcggcgaacggtcacgaccactgaggccgtgaccgtttcgtcagacggcacgcgacctgccggcacatcgtcgggaggcgatccctggcatactgccgcgtgtgcagatgtccggggaactgcaggtcgactacgccaccttccgccgcatggagttcaccgacccgagattcggtctccggatgctcgccgcctggatcttcgcgctgatcctcctgggctccggggtgtggcacgtgctgaccgagccgatcagcgtccagcacgcctacctgttcctgttcgccctgggcttggcggcgattcccgatgcgctcatcggattgtcgtggctgacgcagcgcaagcgctatgccgtgccggcccgctatcagataaccgcgcagggcgctgccgagcacaccgcggccggcacccggcaggtggcgtggtcggaggtcgcccgggtgaaccgcgggcggcacgcgtggacgatcaagaaggcgttcggggccgaggcgttcgtgatcccgcgggcagcgttcactccggcggcgagcaagaccatcaacgacttcttcctcgcccacccggaattcgcgggataggcgaaactccgccgggccgcgttcagcccttctgccgatccggcggtgtatccggacgcgaaccaagcgcgaatgctggattcaacggcaaagccagaagccgcttccctcgtgtcgagccgcctcgccgtccgggtgccgaacgaaaagcgatgagccgacgatccagacgtggtcgccgggctggaggaacagcggtcgaggaagctcgacagcccaatcgccggcctccaccttggtcaccatggtcagccgcgccaccggcacgggttcggttcggacaaacccggcggggtcatcacctggccccagctgcaactgcatgcatcaaggctaccgggaacgctgcttcaccatgcaataccggccggcgccgccggcgtacccaggccagaatggccggaacagccggcgtgttcgtggcggtgatcgcggtcgcggccggagtggccgtcttcgcctcgccctccgctcggcagccggacctggcacagtcatccggtccggcaccgctgcccaccggagcattgcccaccgtcgccttgtcgctgtccaagccgtaccacgacttgtggccggacgcgctcgtcgcgttgccgctgcggctgccggacgggcggcggtactccgtcaaggcggaattgggcgctgaccggtacctcttggaaccgcgggacgatcagagacgctacctgccggtggtgttcaatgcccggaccggcgtgacgcgggaactgggcacggttccgacgtccggcttcaccgtgtacgacccggctggtacgtacctgaccgatcactacatcgcgtgggtggtgtcggcgcaggaaaccagaggcgcgaagtattacgaggtgtggagcgcgcccagagacgggggcacagccgtgcgccgggcgacgttcggcccggacgagatgaccgtgtcggtcgccgaggtcggcggggtcttctacgccggcaccgagcccgccgaaggagccggggcgatctaccggatcctcggaggcgcagtgcgatacgcccggcgccgtgcccgtcggatcctgccggtctactgggctgccctcgccaccagcgcactgatcgccgccatcgtgccgtccctgccgctcagcgccccgcccaccctccggtcgaccatcgtctacgccctgctgttgcaagacgccctcgccgcacccgcccccaacggcgccttctggtcgatcgcggttgaagccggcctgtacctcgccttcccgctcgtgctggtggcccgtcgacgatgcggcgcgacggtcaccctcgccgccgtcaccgtgccggtgatcaccgcaggcctgctcctgcctgagctgtccctcaggcctcgagcgatcggttacacgctggagctggcacccctgttcaccatgggtgtgctggcggccggcatcgtgtcggcaagcgaccgggtccggcgcctgccctggctcgccctcgccgggatgacgggcgcaccggtactgatggtgatcgtgcttcgcggttcagcatgggcagtcgttcactactactggctcgacctcgccgtcgggccggccatcggcttgttcctcgcggccctggccacccgccggcccctccggctcacccggctgttgaacggcgcgccgctgcgaaaagtcggcgggttctcctacagcctctacctgatccacatgccgatcgtcgccctgatcagcaccctgctcgtggggccccgcaccggtccgcacctgacgaccttcatcgtcaccacggtgctggttgttccgatctgcctggcgacggtacgattgttcgcagccgtcttcgaaatcccgttccagcgctgccaccgacggcgagagagtggaccggtacacatctcgaacgcctctgcctgttcgtagccttcgcgagcacgcagcagccggtcatccgccacggccgtcctccgactcaccgtcgacaggacgcggacgagctgtccgatcccgtcgacgttcaacgcctaccgccagtatttcaaggccggcgactacaaccagatgtcgtcggacagcaccaccaacggcgccgaggtcgagttctaccgtctgaccgggaaacacggctgagccggatccgggggaaccggcccgggtcgggcccgctcgcgtgagaacgtcagaggggacccgaggaggacacgatgatcacggttgcggccgggagcaccctcacgctgcgctgcccggacatggagacgatcccgctggtctgcctcgcgcaggtgcgggcgccgttcatcgccgacctgccgccgctgccggtgctcagtctcgacgagccgggcgtccggcggtacgggatcctggagctggtcagcagcgccggcgtcgcctgggtggaggcggaactgcgcggcggcctgatcaccgtcctcggcgactcgccgaccggggtggtgcagcgacgggactcgccgcggatcgccgggacgtatccggcgttcggcaccgcccaggtcgacaccggtcccggccagcggctgatcgccctgagcggccacgtgcgcgacgtctcgaccagcggtctgctgctgcgggccaccgccggcgacgacagcccacacctgcccaccgcgatcctgcgcaccctgctgcacgtgaccatgccgtggggcgagatgaccgcgtcggtcaccaccgtcgaccagcgcgccgaccagctccgcggcaccttcgactggatcgatccgggcgacgcgaaagcgctcgccgcgttcgtcggcgcccgccgctgaggccgggaatccgcgccgccgggttccctggtcatcctgccgagtgggcggaccacccgggtccgatccacctgccatctggacgcgcacggccgacctggagtgatcaggcggtctccttgcggcggcggcggtcgcggacgtagatgaccgcggtcttgcccttctccgtggtgcggcgttccgactcgaacagggcggtggccgcgagcaggtcgctcagcttggtgtaaccccagttgcgggcgtcgaagtcgggactctgcttggtcaggatgtgcccgaccgaggcgagggtggcccagccgtcgtcgtcggaagccgcctcgaccgcgttgcgcagcttgttgaccagcgcgctgtccgacttgagccgggcggccgggatcggcggctgcggggccgcgggggcgtcggccggttccgcggggctgtgcggcgcggtcaggttctcggtgtagatgaacttgtcgcaggcggccacgaacggtttcggggtcttccgctcgccgaagccgtagacgatcaggccgctctcccggatccgcgcggcgagccgggtgaagtcgctgtcgctggacacgatgcagaacccgtcgagccgcccggagtagagcaggtccatcgcgtcgatcaccatggcggcgtcggtggcgttcttcccggtggtgtacgcgaactgctggatcggctggatgctgtacgccagcaggtgctccttccaccctcgcaggttggtgcccgtccagtcgccgtaggcccgcttgacgtgcgcggtcccgtatttcgccacctcggcgagcagcccctcgacgatcgccggctgcgcgttgtccgcgtcgaccagcaccgcaagccgcgcggcgctctcgttggccccgatgctcatcgcacctcccgctgcccgacgatacccaacccccgatcatcaccggaacgccacgggcccgcgcccgcccgccgtgggatctcgcggcacggccggcgagcgggcggccgctaagatcggatcgtgagccgcctgatcctcgacgagaccgctgagatcggggtcgacagccgcggcctggtgcggggcgaggacaccgtcgccgagtggcgcgaccccgacggtccgctgccctgggccgtcgaggactggcagcccgagcccgagatcgtggcgtgcgcgcagctgggcgagtgggcggcggtcctggcccgggtcggccggcacgcccagctcggggtccggcgcgacggccgccgccccgactggcacggcctgagcaaatcgcccgaggacatgaaccgggggatggtcggcgccaccctgctgggcccgctgcgactggccgaggtcaccgcggtcacccgccgtgaggacctgatcggcgtgcaggtgcagggcgcccgccgggtgcagcagatcgtcgtgccgcggcatgtggagaatccgcccggcgacgcgctcgacccggccttggcccggcacgcggtcaccgccatcgccgcgcaggcccccggcgccccgctcgacctgcccgacgagctgacccgcgacctgcagcggctgctgcaccgcaaaccgttccgcaccacgtggatcgcggtcggcctgcgggtcgccgagacgtgggagctgcccggcgggtttcaggtgccggtggtctacgacgtggagccgggccaggtccaggggttcgtggtggacgaggcgaccggcgcgccgcacagcaccctgcaggcctgccgcaaccatcacctgtccggccggcccgcctggtgctcgtactgcctgagtcccacctgcggggcgtgcgccgaggcggtccggccgtgccggctgtgccagggcgcggtctgcggcgactgtgtggcgaccgcggacggccgctgcccggcctgcgcccggctgaccagggtcggcatgctggcccgcggccgctacggggtgtccggcggcggctcggtctggcacggcgaggttcccaacgttcaggtcaccatccgtgagcagcgcaattattggacgctggagcgctgggaccgctatgaccgggtcaccttcccgctcgatccgcccaccatccatgcgttgcgcgagtgggtcaaaacctcatgatcaggcggaccgtcgaccggcggaatccgtgagattcgcggcctccgcctcttccgccgtggcgcaggcgacgaccacgtcgtacatcgtgcggtagaacgccgcggcggccagcgtcgagcggcggtcgacgccgcccgccagcttggcgtggccgttgcggtccggcgcgaaggccagcagatagcgggcgctgctgcgggcggcgagcgcgtcctggaagacgccgcgggtggtgccgggtgcgacgcgtgactcgaggacgaccaggtcctggtcgcgcagatgcccggcgaccgtgtccgcggcggccagcaccaggctcaggtcgggccgcccgcggtgcggcggggccgggacggcgatcaggtgcacggtgcagccggacagccaggccgggtcgtcggtgacgtggtaccgcccggtctcgtgcatccgcaccaggtcgtcgccgagcggtgaccggccggcgcgcagttccgcgacgaggccggcgtcgtggtcgaatccgacgacggtgtgcccggcggtgaccgcggcccgggcgagggccaggccggcgcggtcctgcccgacgacggcgacgcggtgacgggtggcggcgaactcggctgaggtggcgatggcggtggctccttgccgtcgtgcggaaacggtcgagaaagaagatagatcgcttcggctctgtcggtaatcgctcggcgggggtcctccgatcggcgctttccgcaccgttcgagcggttccggtgtccgtttccggtcagacccttgagcccaggatgtcactgaccgtacggatgagcggcgtccgcgggtgaccttcgaccttgacaggcaagcgcctatcccagcagggtggagcgcctatagctggtgatctgggcggcgcgccgagcgggccgagccggtgggcaaatggttacacacggtgagggagttcgggtggatctacatccgcaggactatgacgacctggtgcacgggcagtcgatggtcgagcagtggcggcgcagtgaccacgcggtcgcggtggccgccgagctgatgaagctgcacggcggcacggtgccgatgagcgagctgctctgggccggtgccgaggccttcctgccgcgtcagtggaacgccggccgggccgccgagcccgccgacgccgcggccgaggtctacgaccggtggcgccggctcaccgaccgccgcctgcagcggcagcggcaggccgaggcggcccgggccgagcaggcccgccaggagcaggccgacggcaacaagagctgatcagcggcgccgcttcagggtgcgctcgtagtcctggaagcgcgccttggcgatcacggaccggtccgcggtgcgcagcacgatgccctcgggccgtccctggccgctgtcgtccagagcgaccagggtccgcggcagccgctcgccgaggaacgcgtgcatcccggccacgtcggccggcaggtcggcgccgtccatggtgaacagctgcggggccaggtcgaaggcggtcaccgcgcgcagctcgtcctcggtggcccaggtctggccgccgtcctcgcgccaggcggcgatccgtggcgccggccaggtcagcagctcggcgagaccgctcacctcggcgacgtcgaagagccgccagccgatcgcgccccgggtgctgtagttcttcgcctgggcgccgatcctgccgccgtacagctccaggtagtacacccgcagggtgtccgccggcaggtgctggtcgggcaggttctcggcgacggtgcgcaggctcgcgacgatgccctgcgacgggttgccgatcaggtcgccgcgcgcgtacagcagctcctcgcgcgagccgatcaggtgattgccgtcgggcagcatgatcaggcgcgagttcgtgccgtcgatcttctccgaggcgtacaccgggccgggcaggacggtcaccgtctcggtcagcccgccgttgcgcgggtccagctcgtgataggtcgggatcgacgggtacttggtcagtgagttcagcgcggtgaggtcggcggtgcgcatgtcgaagtcggccatgcgcacaggtatgtcatgccggcgccccgcaccgctagcgatttggggcgccggcggccggtctcagttcacgaacaccggggccgcggcggaggtgaccaccggggtgtaccgggcggtgaagtagccgtcggcgacgcacgccgccgggccgctggacttggtgaagtgctggtcggtgaaggtgatcgagttgtcggtgttgtcggccaccgcgctgatcgtgttgttcgccgcgacgaagttgcaggtgaccgagcccagcagggacttgaggtcgagagtggcggagatcggcgcggcgtcggtgccggagaccgtgacggtgccgtcgctggcgaccgtcgtggcgtacggctgcttgttgatcgtgacgctgttgacgccggtgaccccggggacgccgctgaccgtgcagccggcgacggccagggtggcgccgagcgcggcggcgccgggcgcggccgggttgtcgttgaccgtggcgctgaagctcgacgtgctgcacttcatgccgttgctgccgcccggtgcggtggcgaaccgggccaggctgccgctgacgatcccggccgagatggtgtcaccgaccgcgacggccgggccggccagggcgtcggtcgtcaataccgcggtgtcgtcggccagggccggggcggcggtgagcagcagggtggcggtgacgccggtcagggccgcggcgatgatgcgggacttgtgcatgggggtgcacctctctggtgggaaacgggggatcaggatgctgcgagggcccgggtcaggtcgtccaggctgggggagacggcgaacgaggtgtcgttgccgctgaacacgaccgcgttcctgccggccgccgagggcagcgggccgaaggccaggtcgatcagcgggtcgaggctgcccgggatcaggccgcagccgctcgccttcggcacggcgtacgcgttgtcgaccagcgtggccccggtgaagccgacgccgagggtctggaagccgttcgggtcagggtcgatgctgatcgtgccggcgtcgccggtggccggcttgttcggtgccggcgggctggtggttccggtggtcgggctgaagcggatcgggtcggtgtccgatccgatgtagcacctggcgccgaacagcgcgttgtacaggtgcagtttgatcggcatgacgaacaccggggtgtcctcgccggtggccagcgggacgaagccggtgatcgggccggccagctcgacctgggcgaagacgctggtcactccggggatgatgttggcaatgccggggatggcgacctgcagcggtttggcgaccagcgtcctgcccccggccgcgggcacggtggagtacacgttggcctcggagccgtcggggaaggtccgggtcggcgccgaggccggccagtacaccccgaactgcagggtgatcgggttgttcagggccacggtggtcgatccgatcgtgacgctgccgccgtgggtgaccgagtacacgcagccgacctgcaggttcgacggatccttcatggccggcgcgctgagcgggcagttctccattccgctgtacgtcgcggcccgggccgccccgggggtgagtgccacggtcgccacgctggcggcgatcatggcgaggatgaatgtcagccgtgacgcggtcatgcgccactccttcgaggggatcgcgatggacggtgggtgcgtcccggccgtttccgcagcgttccggggcttccagtggcgggtgatactggggggacccgccacgggcaccatcgagagccgtacctgacggtatgagaaaccccagcggtatgtcatgtcaagacattgagggacgacaatgacgaacacagcaatcgggcccctcccgggcgcccgcgccggacgtgatcccgcgcgggcgatcaaacgcggcccgcggtcgatgacgcccgaggcggtcgccgcgacccagcgggagcgcctcttcgacgcgctggtgcacacggtcgccgagaagggctacgcgaacgcccgggtcagcgacatctgcacggcggccggggtgacccgcccggcgttctacgcgctgttcgccggcaaggaggacgcgttcctggacacctaccggcacggtacgggtgtcgtgctgcgactgatggacgacgcgtacgcgaacgccggtgactggcacgacggcgcccgggccgcgctgaaggtgctgctggacgtgctggccagcgtgcccgccttcgccgcgatggcgatcgtggagatcgacgcggccggcccgctggcccgccgggagcgcaccgagctgctcggccggttcgcccggttcttcgccgaggcgccgggcgtgccggacggcctggtcggtgcgatcgtcggcggcgtctacgcggccatctacggtcatgtctcgaccgggcgggtggcggagttgccggacctgctgccgatgctcagctatttcatgatggcgccgttcctggggcgcgacggcgcggccgcggagctggcgtgccagcccgccggggagcgggtcgtcgcaccgtgcgccacgtcagataccgacgaggtttttcactgaccggaatgcgggcggatcggcttgacgcatctcgttaccgcggcgtaacttcgccgaaacgcatcgagagtcaccgatagtttcgctggcggcggcatccgcagtgccgaccgcggcgacatcgcccgcaaaggagcgtgaatgtcctccacccgatacggccacacccgctggcgccggttcaccgcgatgctgctgggcggtctggccatcaccgtcggcctcgtgttgctgaccggcaggggggtgctggccgcctccttctcgatctccggcatgccgttcaccgtcaccagccccaagctgcacggctacggcttcgagcagtacgccgagctcgatcagatggccccgggcagcccgaacgagggtgacaccggcggccaggtcgtggtgatcgtctccgcgatcaaggacgcccagctcgacgggctgtgccagagcatcgcgctgggcggcatcaacctcaagatctcggccggcagtgccaccaacaaggtcaccgccgacacgctcgtcgtcgactccgacctgatcaccggcaacgccgacttcaaggcgatcgacatcggccgggacgccagcaccctggaccgggtcaagggcaagaccggcgcgatcggcgtgttcggccagcaggccgaagaggtgaccatcaccaacctcaagcagaacaactacgccaccacggcggccaccttccacctgcccagcctgcacatgtcgttcacctcggacggctgctgaccatgtccggatccgccggagccgaccaccgggtctcgccgggcgcgcgcgtctggcgggccttccggcactggcagctggcccggccgttctggggcggcctgctggtgctgctcggtgggctggagatcctgatgacggtgtgggcgccgctgggcgtcgtgctgcacgtcggcatgcagaacttcatcggctacctgctcccgctggtcatcgtcctgctcgggctgctgatcctgttcaacccggcgcaacggatcttctactcgctgatcgcgatggtctgcgcgctggcctcctggatcacctcgaacatgggtggcttcctgatcggcctgctgctcgccctggtcggggcggcgctgaccttcgcctgggcgctgcccgcaccggtcccggtcgtcgccgaggcgccggaaccgcgatcccccgacaatccggagccgtcggcgtagcgtgagaagaccgatcgtcaaatcaggggggagatatgacgatgagcagcaagtggagtgctgttaccgcgaccctgctgtttctcggcgggatcgggatcgttcagggcgttgccgtgtcgcccgccacggccgcgcccgtgccggccggcgtggttgccggcggcgcgcacggcggagccgcggtcggagaccgggatttccgtcagggataccgggacggctacagcgacggctggcggcaggccaagcaggactgccgtgagccgctgaccgccttccgcgggttgcgcaaccgtgacgacgactatgcccgcggcttcgaccggggcttcgggcgcggtttcgcggcgggcttccgcgagtactgctgatcctgcaccaccgcgaactctccaaggtgacatcgggggcgggcgtgagcgctcgcccccgatgccgttgcgccgcggcgtccggggaccgactcgaccggctcgccgccgtacgcccagccgcgcagcgtgccggacatggccgccgccgacgcgccggagcgggggcgctgccagggcgctgagcgtgtgtcgggggagaagcaatcggcgccactcgatataggggcttcagcgggacacccttctcgtggttgactgtcggatcaggtgggaaagccctttcctggaggtcgcgatgcgtcggcgtaccctgttgaaaattcccgcactcggtgccggagcggccgtcacggtcccgcaccgaccggacctgatcatcgagccgggggacagcgtgcaggccgcgatcgacgccgtcgcgaccggggtgatcggcctgcgccccggtgtctaccgcggccgggtcatcgtgccggccgatcggatcggcctggaactgcgcggcctcgggcgccggccggacgatgtggtgatcgccgacgaccgggccaacggcacgctcaaacccgacggcaccccctggggcacctccggcagcgcctcggtcaccgtcgacggcgccggcttccgggcggtcaacctgaccttcgccaacctgttcgacgaggcggcccacccggagatcaccaaccggcaggcggtcgccgtgctgacccgcgccgaccggctcaccttcgaccgggtccggttcctggccaaccaggacaccctctacgtgaacagcaccgcggccggggtggcggcccgcgcgtacttccgcgactgctacgtcgaaggcgacgtcgacttcatcttcggccgcgccaccgcggtgttcgatcgctgccacctccactcgctcgaccgcgggaccagtccggacggctacgtgaccgcgcccagcaccgacgccgccaacccgcacgggctgctgttcgcgcactgccggttcacctcgaacgcgccgcccggcacggtgttcctgggccggccctggcatcccggcaacgacccgggcgcgaccgggcagacgatcatccgggagtcgtggatcggcgcccacatcggcgcgaccggctggagcgacttcggctcctggccctggcgggccgcccgcttcgccgaatatcgcaacttcgggccgggcgcgcggtgcggacccgaccggccacaactcagcagagccgaggccacgtcgtacgacatcgaggattttctgtggtgaagtttctcctcgccctactcctggccctgggtggcgccgccgtgccggccgccgccaccgccgccaccgagcacaccgtcaccttcgacaggtattcgctgatgctcgacgggcggcgcaccttcgtctggtccggcgaattccacccctaccggctgcccagccccgacctgtggcgtgacgtgctgcagaagatgaaggccaacggctacaccgcgaccagcgtctacttcgactggggctaccactcgccggcgcccggcgtctacgacttccgcggcgtgcgcgacatggaccggctgctcgacatcgccgccgaggtcgggctgtacgtgatcgcgcgacccggcccgtacatcaacgccgaggtcgacgccggcggctttcccggctggctgaccacacaggccggcaaggcccgcaccgacgcccccgactacctcgcggcgagcgacgagtggctcgggcggatcgacgcgatcatccggcgacaccagtacaccgacgggcacggaccggtcatcctctaccagatcgagaacgagctggcggcggtcggcgacagccagaaacgctacatgcggcatctgtacgaccgggtccgcgccgacggcatcacggtgccgatcttccacaacgacaagggccgcaacggctactggacaccacccgcggccgacctgtacgccttcgacggctaccccggcggcacctgccgcaccgacggcacggtcggcgcgcccgcggtcgctccggactggggcatgtacggacccggcggcccgaagggcggcgccaccgcgtcccccgacaccccgggtttcgtcgccgaattcggcggcggctggttcgactactggggcagcgccggcacctacccgtgcaccgcgcaacgcgaaggccccggctacgaacgcgtcttctacggcaccaacatcgccaaccggctcagcatccagaacttctacatgaccttcggcggtacgtcgtggggctggctgccggcgccggtcgtctacacgtcctacgactacggggccgcgatcgccgaggaccggtcgctgcgaccgaaagtgaacaccatgcgggagctcggctacttcctgcagagcactccgccgatcaccaaactggaacgcggcccggacctcgtcccgtcctccggcgcgatcaaggtctatcacccggtcaacccggacgacggcacccagttcctgatcgccgtgcacaacccgtcgaacgcccgcaccgacgacacggccaccgtcccgctcaccgtcgacggccgcgcctacaccgtgccgctgcggatcaacggccaggacgcgaaaatcctgaccgcggcgtacgacgtgagcggccagcgcctcgtgtactccacctccgagttgatgacgcacaccgcggacaccctgctgctgtacgggcgggacggggagaccggcgagacggtcctcaactatccggccgcgccggtggtcagcggggcggtggacagcagctacgacccggccaccggcgacctccggctgagctacccgcatgtcgggctgacgtcggtgcggatcagcggcggtgggcggcccgcggtcaccctgctgatcgccgaccagtcgactgcggacaccttctggaagtccggggacgtcctggtgcagggtcccgcgctgctccgggacgcccgcttcgccggcgacgagctgcggctgaccggcgacaccgcggcggccaccccgctgcgggtctggtcgccgcgcccctaccggacgctgacctggaacggccgccgcgtcgccgcaccgggccggcccaccgtttcccgctccggtccgctcacggccctgcttcccgggccggagccggtcaccctgccggccctcgaccggtggcgctggtccgccgaacccgaggagtccgacgacacctggacgccggccacgctgaccggcaccaacagcaccaccgaaccgcccgccggccagcccgtgttgaccgccgacgactacggcttccaccatggcgacgtctggtaccgcggccactacaccggttcgctcccggacacggtcaccttcgactacggcgccggcggcgccggcatgctgcaggcctggctcgacggcacctacctgggccagcacaccctgcccaccgccctggcgtcgccaccgacccgcggcaccgcgaccttcaccgtcccggaagcccggcgtgccaccggcgaccacgtcctgtccatcatggtccggaacaacggccacaacgaggacggcggcgtcaacgacgcccacaaggagggccgcggcctgatctccaccagcgtccccgccacctggaggatccagggcgaaaccccggacccggtccgcggcgtcaccaacaacggcggcctctacggcgaacgccacggctggagcctgcccggctacccggaccgcacctggtccgccccgccggccaccaccccgaccggcacctcctggtaccgcaccaccgtcgacctgcacgtcccgcgggtcgacgacgcgtcgatcgccctgaccatcggcgaacccggggtcaagggcggccactaccgggcgctgatcttcgtgaacggctggaacatgggccagtacatcgccgacgtcggcccgcagcacaccttcaccctgcccgccggcatcctcgacccgcacggccacaacaccctggccctggcggtgaccggcgacggcggcaccctggagccgctccacctgaccaccaccaccgtggtccgcggcggcgtcccggtccgccgggtcgcctccccgccctatcgtcactagcccgggagaaccggccggcggcgcggtcgtcccgcgcgatcggcaccgtcggccggccggcgcggcctccgtgtcagccccagcactcccacccgccggtggggtagctgctcagccggtcgacgacgcccgtgccgtaggtctgccagcaagccgacgtcgtattgatggcgaccttacgatcgccgtccacccagaaccagtcgtgatcggtggcgccccaccgcttcgcgtgaccgacgccgatcgccgcgcaacaatggtgcagataccgaccgccgagcttcgatgcggcccaggcgggagtgcccggtgcgaagatcggaaccgcgagcagcgcattcagaatgcacgaccatgcccgcccgcctcctccgtcggtgtatccgtgccctgtgcgggtaggcggatgtccatgcgtatcggaaacatgcaagtccggttcctcggtggcccggccggctgcctcggcatgatcgtggtgtcgatcctgctgtcggtcgcactgaccgtactgctcaacctcttcctgcggtgaccgccctcgcaatctgcggcacggggggcgtcaccggagacggcgggccgtgccggtcagccaggcatgcactcgtagttcgcacaggacggtccagcccccgaccgcctgatcgatccaccgaagacgctggcctccaccatgtgccggagcgccgggtgtgtccgggacggagaggtcatcgccgacggtcttcgagctttggatcgcccacggctgcggacatgcgaaagggcgcccgttctcgaggggcgccctttccgcatcgcctggccggtgcggctagaaccagacttttcgtccaccgaccgggcggccgacggcaccgaggatccagagcgcggcaccgaccaccaggaggacgaggccgaccgtgtagaggatcgacacgtgcaggaagatgcccaacagcagaaggatgagcccgaaaatcagcacgacttgctccgtttcgtcagcgggtgtctcccgccgaccgggctgttacccagcccctcggaaagccaatcttcccgatggacgacccggtgctgccggcgtgaaaaggtggcccgctgccgggaaccggcgggcatcgtgctccgtcgaagtcgagtcggggagtgcgcggggtgacgccgcaacgggcgggaagtgggcgggcgatgggtgcgggacgaggttcgcggaacagggcggtcgggacgcgccttctcggggcggcgctgctgtgctcactgctgacggcatgtggcgacgccgaggtcgccgcccccgctgccgacccgggcgccgcggccggggtcaccgactgcgggacgttcaccctggggcagggggagagcctgccggcgtccgccgcccgctgcctgatcgaggcggtccatgccgggcggccggcgcggctggcggtgacccggccgacggtcgagggtgacccgattccggtcacctacacggccggtgctgacggccgggtggaggtggtcaccgatgcgcgccgggacaggttcggtgggcggacggtgacccgggacttctgcaccgggccgtctgctacgccggagctggagttcgctcgatgctcgtgatcctggcggcggcccagcgggtgacgggtggatagatggcgccgcccgcggcgaacagggcggcgaggaccagccagccggcgctgtgcaggcccaggacgcaggcggtgaccaggggcggggcgagcatgtcgccgacgccgcggccggcgaagtaggtgccctggtactgcccctgggcccagggtggggtgatcgcgaagacgatgccccagctgccggtggagagccacagttcgccgacgacgtggatgatcgcggccagcgtgatcagggtgccggccagccatggggggtggccggcggtggcggcgaggacggcgcaggacagggcgaggatcaggcagccgcggacggcggcgcgccgggcgccgggcaggtcgtgcacgtcgcgggcggtccggacctggagcaggacgcagccggcggtgttgatgacgagggtgaccgagatcaaccagagcggggcgtgggcgccggcggccagccacagcgggaggccgatgccgagcaggtcgttgtagacggcggagagcagtccgtcgacggcggcgaagaccaggaacgggcggtcgcgcagggcgacgaggcgggggccgccgggcggggtgacctgcgggggaacggccggggcccgggtgagcagggcggccgcgaccacgaaggtcgcggcgttgacgagcaggatcacgacgtacgcccgatcggtctgcagcaacagcgggatgctgccgccgagagtgccgagaccgatcccggcgttggtcatggtgcgcattctggcgcgcatccggagccggccggaggccgcgacggagccggcggcaagcgcgccgttggcgcctttgaccagggcggtggcgaccgcgatgacgcaggacagcagcccgaacgccagcggggagcggaccgcgagcagggcggtgtacgcgccggcgagcacgatcagggccaggatggacagtcgtttcgggccgtgccggtcggcgaggtagccgagcggcgtcatcgccagcaccccggcggcggccccggcgctgagtccgatagcgatcatggcggggctgaggccggcgaccgtggtcaggtagagcacgctgatggtgacgtaggcgccgttgccgatcgcgttcaccagggtggccaggaggaggacggtcataccgtccatctaacaagacgtacgtacggttttcaacggggagtgccgggagaaggcaggcgcatcagacagccgaccgccatcgccgcggcccgcctgatcatcaccgaaggcgccgggcgccggcccgcgcccatcgcgccgctgggcaccggcccgcgcccatcgcaccgctgggcaccggcccgcgctcatcgcaccgccggtgagcggcaccgtcgtggccgccgcgccgagctcttagcgcggccttaacgatcggacagcgtgccgatagccaccgccccgcgaaagtgtgcacatccgaaacgacctggaggttcatccgatgttgaagatccgtaccgcggtgttcatggctaccggcgcactcgccgctctcggcgtggcgggcaccgcgctcgcggcggacggggcagacgacacctcggcttcgccctcggcgtcgatggcggcgtcgtacgaccggggcggtgccgccgtgggcgtcgcggaagccaaggcgatcgcgatccgggtcgccgggggcgggtacgtgcgctccgtcgagcgggagaccgagcacggccgtccggtgtgggacgtcgacctgatcgtcggcggcgtggagcacgacgtggacgtggaccgggccagcggcgaggtgctgcgccaccggatcgagggggcgaacggtccggccgcgtcgggcggcgccaccgcggcggcgtctgcgtcggcggacgaccacggccggcaggccgagccgggcgacgacaggggcggcgcgagcacgcggtcgcggcgcgtcgagcccggggacgacaacggtggtgcgggcacgcggcacgccgagcccggcgacgacaagggtggccacgggcgtggcggcgacgaccggggcggcgacgaccggggtggccgggggcgcggctcggacgactgacgccggccgcggcggccgccccgcccgtggggggccgccgctcaccgtcgtacggtgataaaaaggtttttgtgatcatcgatgattcgtcgccgttctccgatctggacgcctacacggcgctgcctcgcctcggcgggctccgcctctccccggacggccgccgcctggtcgtcggcgtcgccaccccggaccggaagaagaaccggtatgtcagcgccctgtgggagatcgacccggacggcgggcgaccggcccctagctagctaggctgtggctgctcccggccggtggcggcgagccgcggctgctgaccgctccgggcggcggggtgcgcggcccggtcgtggccggcccggacggcacggtggtgaccggcgcgtcggtgctgacctccgccgccgacctggacgccgaccggaagctgcgcgaggggcgccgggacgccggggtctccgcgatcctctacgaggaatatccgatccgccactgggaccacttcatcggggccgaccgcacccgcctgatcgccctcgacctcggcgccgacgctgccgggcagcccgtgccgcgcgatctcaccgggcacgccggacgggccctcggcgaggagccggcctgggacctcagcccggacgggcgcaccctggtggcgctctgggtcgtcgccgagccggccggatcccagcggaccaccctggtcgcgatcgacgtggccaccggcacgcggcgcaccctggccgacgacgaggactacgagtacgacgggccccggatctcgccggacggcacccgggtcgccgtcgtggcgtaccgccgctccaccgcgaccgaccccggtgaccggaagctgatgctcgtcccgctggccggcggcccgcagcggtcgctgaccgaggcgtgggaccgctggccggagacgatccgctgggcgccggacggcgccgcggtcttcgtgaccgccgacgaccaggggcgctgcccgctgtggcgggtgggcgccgacagcggcgaggtgacccggctgaccgacgacgacggcgcctacaccgagttcgaggtggccccggacggctcggcgatctacgcgctgcgctcggcggtcgacgccccgccggccgtggtgcgggtcgccctggacggcggcggggtcgccgagcttccggggccggccgggcggccggtgatccccggacggctgaccgaggtgaccgcgaccgccgaggacgggaccccgctgcgcgcctggctggcgctgccctccacggccaccgcggcggatcccgcgccactgctgctgtggatccacggcggtccgctcgcctcgtggaactcctggcagtggcggtggaacccgtggctcgcggtggcccggggctacgcggtgctgctgcccgacccggcgctgtccaccggttacggcgtcgcgttcatcaggcgcggctggggatcgtggggcgccgccccgtacaccgatctgatggccctgaccgacgccgccgagcagcgccccgacgtcgacgagacgcgcaccgcggcgatgggcggcagtttcggcggctacatgaccaactggatcgccgggcacaccgaccggttcaccgccctggtcacgcacgcctcactgtgggcgctggaccagatgtggggcaccaccgacgcgtcgttctactggatccgggagatgaccggcgaggccgtcccggccaactccccgcacctgtccgccgaccggatcaccaccccgatgctggtcatccacggtgaccgggactaccgcgtcccgatcggcgaaggtttgcgcctctggtgggacctgctctcccggtccaccgccgcggacggctcgtcgccgcacaagttcctgttcttcccggacgagaaccactggatcctgaaaccggcccacacccgggtctggtacgaaaccgtcctcgccttcctcgcccaccacgtccacaaggagccctggagccgccccgaactgctcggctgacgggccgctcggcgggacctccggccggaggtgaccccgggccggtcagcgggccggcagggccgggcgggcggagcggcggacggtcgcggtcgcgtgcagggccgcgccgtccgtcgattctagctagctagaaccgctgtgccggatccttggcgagggcccgcagcaccaccgccgccaccggccgcggcacgtccggcggcagcaccggcggttgcccgtgcaccagctgcgccagcaccgcgagcgggttgtcgccgacgtagggcggccgcccggtcaggcaggtgaacgcgaccgcgcccagcgcgtacacgtcggtggccgccgtcaccggctgcccctcggcctgctccggcgccatgtagtgcgccgagcccatcaccacgttggtgccggtgatcccggtgatccccaccgaccgggcgaccccgaagtcgaccaggacgatcgccccgccgggtcgcacgagcagattgctgggtttgacgtcgcgatggatgatgccggcctggtgggcggcatgcagcgcgtcggcgaccccggcggtgatcgccatcgtctcggccgggctgagccggccggcctgctgcaccttcttcgacagtgaggtgccgtcgatgtactccatcaccaggtagtcgaagcgctcaccgtcgaccaccgcgttctcgccgtagtcgtagacctgcacgatgcccgggtgccgcagctgggccatcatccgggcctcggaacggaagcgggtgatgaagtcccggtcgttcatcagcgccggcagcagcaccttgaccgccacctcgcggtgcagcagccggtcgccgccgcgccacacctcacccatcccgccggccgcgatccggtgggtcagctgataacggccgttgagcacgattccgggggcaagcaccgggccatgctagtcggcgttcccgagaatccggttaaaccaaaaatcaagaccgggtttgcgtacgccgtgagcaccccgccgccgagggagaaaccggtgatcctggggcgatgttcacacttcgacatgtccgaaatggtacgactgtctggtaccgaccggcgacacctatggatggtcatgaaacgtggagcatggacagtggtcacgctcggcctcgccgccgcgacggtcttcggggctgtgcccgcccgggccgacgagagcaaatccgcggacaagagcgcgacctactgccggctccgggtgcacggtggcatcctgagccactaccgcacgctcggctcggacaaggggcggctcggctgtccgatgggcatcgagcagtccgcggccggcggcgggcggatgcagcagttcgacggtggctcgatctactggtcggcgcagaccggcgcgcacgcggtcgccggccggatcctgcaactgtggcagggcaaccggggcgaggccggctgcgtcggctacccggtcgacgaggagtcggacacgcccgatcaccggggtcgctaccagcatttccagcggggcacgatctggcactggaacgacggccgggtcagcgcggtctgctgatcccgggtcgtttctccggccgcctcgatctcagccggccgtgattcggaagaccgggaagccgggagccgcggccgagatgtcggcctccggcgaatccgctgtcaggccgtcgaagaacgcgccggtctcccacgcccacttgcgcaggtagagccggatcagctcgctcttgtccgcgtccgccacctccgtcgcgacgaaccgctcgctgcgccgcccgagccgcagctcaccctcgccggccacccgcaggttgcgcacccactgggtgtgtccgcgcggcgccagcaggtagcgctcgccgtcgtgggtgaacatgttgacgatcgtggtccgcacctcgccgctggtgcgcccgcgcacggcgagcacccggctgcccatcaggctgatcccgtgggcggtgagctacttggcgaagtcgttgaagacgttcgtcgcggatttcggggccaggtagcgcatgacgtcctccggagtctcctcggttgagagcagtgctctctcttgcaagcagtgaacaccagtcacccgctctccgtcaagagcagcgctctcgcttggggattgacggtcgttacttagtcgagtaagaatttactcatgcgagtaaacgagacggccgcgacgagagcccgacgggcccagatcgtcacggccgcgatcgacacgatcgccgagctgggatatgccaacgcgtccttcgcccggatcgccagccgggccgggatcagcagcacccggctgatctcgtaccacttcgacgacaaggccgacctggtccgggcggtggtcggcgcggtgctcggcgaggcggccgccttcatgggcgagcggatgcgctcggcgcgcgaccggacgggcctgctcaccgcgtacatccaagcgaatctgatcttcattgcggagcatcccgcggcgatccgggcggtcatcgagatcgccgccgcggcccgcaccggggagggcgccccgctggttgacccggcggacgccgacgacccgggggcccgcctcgccaccatgttccgcgaggggcaggaggccggcgagttccgcaccttcgacccgcacgtcatggcggtcaccctgcgcgccgccatcgacgcggcggccgtccagcccgatctcgacccgcacgcctacgccgcggagctggtcgccctgttcacccgagccatccggaaggacgagctgtgaccatggtgaagaccccgtcccgcccgagccggttcgcgccggccctcccgatactgatcgatttcggcctgccgctcgtcgtctactacggactgcgcgcggccggggtcgaccagtggtgggcgttgctgctctccggcgtgatcccggcggtcctggtgatcgtccggttcgcccgcacccgaaccgtcgactacccggccctgttcgtcctcaccatcgtggcgctcagcctgggcgtctcggcgatgaccggtgacgcccgcaccatgctgatccgggatgcctggggtggcctgttcggcggcctgatcggcgtctggctgctggcctcggtgtgggtcggccgccccgcgctgatgtatctggtccgcgccttcgtcctggccaaggtgggcgagccgggcctgcgcgggtgggagaaccgctggcacaccgaccccgggttccggcacggtctgcggacgatcaccttcgtctggggctgcgccagcctgctcaacatgctggtcaccgtgctggcggccgtcctgctgccgctcgacctggcacccgccgtgctcaacgccggctggccggcgatcgccgtgcccaccttcctcttccatctctactacaccaggaagaaggacctgcgagcatgacgtacgacgtgatcgtcgccggtgccgggccgacggggctgatgctggccggggagctcgcgctgggcggcgcccgggtcgccgtgctggagcggctggcggcccgcaccgggcagtccaaggcgctgaacctgcagccccgctcggccgaggtgctcgcctcccgcgggctgctcgacgacatcctggtgcaggcgccggcgctgttgccgcacgggcacttcgccgggatcccgctggactacagcacgctggacaccccgtacccctttcaggtcggcatcccgcaggcgcgggtcgaggagcggctcgccgcgtgggcgacgtcgctcggggccgagctgcggtacggcaccgcggtcaccaccttcgcgcaggacgacgggggagtgacggtcgacggcgaacgcgcagcgtacctcgtcggctgcgacggggcgcgcagtgtcgtccgcaagcaggccggggtggacttcgtcggtcgcgacgcccgcgtctgtgcactcgtcgcggatgtgaccctggccggtgacggcccggcgggctgggaactgccggcaccgaagggcgacggcatgctgaccgtgctgccgctgggcgacggggtgttccggatgctggccgccgggccggtgcaggcggccgccgggcgcgacgatccgatcccggacagcgagctggccgacgcgctggcccgggacgggctgacgctcgatgcggtccgctgggcgagccggttcaccgacgccacccggcaggccgcacggtatcgacggggccggatcctcctggccggggacgccgcgcacatccactcgccggccggtgggcaggggctgaacctgggcctgcaggacgccttcaacctgggctggaagctcgccgaggtgatccgcggggaatcgggcgacgcgctgctcgacacctaccacgcggagcggcacccggtcgccgcccgggtgttgcaggcgagccgggcgcagggcgtcctgtacatcgcggacgacgacgtgctcgccctgcgcgcgatggtcaccgagttcgtggacacgcaggcgctggcccggcgggtggccggactggaccacggcgaccgcatccccggcctcgacctgacccggctgcacgacggtcgccgccacgtgatcgacggcgtcccggtccgccccgacggcttccgctggtccgcgcccgcctccgccgcggtctccgctcaggcggccgcgaactgggtgcggtagagctcctcgtagcgtccgccggaggagagcagcgactcgtgcgtgccgcgctccaccacccggccctgctcgatcaccaggatctggtcggcggcccggaccgtggacaaccggtgggcgatcaccaccgcggtccggccggccagggcctcgccgagcgccgcctgtaccgcctgctcggaagtcgcgtcgaggtgcgcggtggcctcgtcgaggaccaccacccgcggccgggccagcagcagccgggcgatggtcagccgctggcgttccccgccggagagccggtagccgcgctcgccgatcaccgtgtccagcccatccggcagcgcggctaccaggtcggcgacatgcgcccggcgcagcaccgcccacatctccgcctcggtcgcctcgggccgggcgagccgcagattggcccggaccgaatcgtggaacagatgcccgtcctgggtcaccatgccgagcgtggcgcgcagcgacgccgcggacaggtcgcgcacgtccaccccggccagccgcaccgcgcccgccccggcgtcgtagagccgggggagcagaccggccatcgtcgacttgccggcccccgacgagccgaccagcgccaccatctgacccggctcggcggtgaagctgacgtcgtgcagcacctcgctgccgccccgggtgtccagcgtcgccacctcctccagggaggccagcgaaaccttgtcggccgacgggtaggcgaaccggaccccgtcgaactccaccgacaccgggccgtccggcacctcccgggcgtcgggcttctcccggatcagcggctccaggtcgagcacctcgaacacccgctcgaagctgaccagcgcgctcatcatctcgacccgggcgccggccagcgaggtgagcggcgcatacagccgggtgagcaggatggccagcgccaccacgtcgcccgccggcaggctgccgcgcagcgcgtagtagccgccgaggccgtagaccagggcgatcgccagcccggacacggacaccagggcggtcatgaaggtccactgcgccatggcggtgcgtacgccgatgtcccgctcccgccgtgcccgggccgcgaactcggcggactccgcctccggccgcccgtacagcttcaccagcgtcgcgcccggcgccgagaaccgctcggtcatctgcgtgttcatcgccgcgttgtgctcggccgccgcccgctccagccgggccagccgcccgcccatccgccgggccggccagacgaagatcggcagcaggagcagcgccagcacggtgatctgccacgagatgccgatcatcacgatcagcgtgaggatcagcgtgaccaggttgccggccaccccggacagcgtgtcgctgaacgcccgctgcgcgcccagcacgtcgttgttcagccggctgaccagcgcgccggtccgggtgcgggtgaagaacgcgaccggcatccgctgcacgtggtcgaagaccgtggtgcgcaggtccaggatcagcccctcgccgatccgggccgagaaccaccgctgcgccagccccagcccggactcgccgagcgccaccagcgcgatcgccgccgcgagccggacgaccaggccggtgtcggcgccgccgacgatcgcgtccaccacccgcccggccagcaccgggccggccaccgcgagcaccgcggcgaccacgctgagcgtcaggaacccggtcagcgcccttcggtgcggccgggcgaaacgcgcgatcctgcgtaacgtggccagggagaacgggcgtttctcgtcctgctggttcatcgcgtggtacatcgaactccaggcagccatctccatgctcatggcccgacggtggcacctcatcccggcttgaggtcaagcgcctattccggctcggccgtcaactggggggtgaccagcatcgaccgggcgctctgggcgagcgcggcggcggcgtcggccgggaaggcgaccgggtcgaccgcgggcatcagcgggcgcccgcacgtcgcccggctcacccgggacagccgggccggccccgggtggtcgaaggcgtccatggccagcagccaggccgcgttgtcgtacgccatgccgaagtgctcgaccgtctccaggggacacaggtcctgcacggcgaggttggtgacgttcggcgcgggcggcagggcggagcggcggtacggcaggatgatctcgtcgtaccgggtgtagagctgggtgtaactgatccccggccaggtctgcggaccactgttgagcgcggcgatgaaggccgcgttcgagcgctgctgccagtacgcggccgagcacaccgtctgggcggcgcactgcaccacgaactcgtcggtgccgtggttggaggcggacagggagacgtagtcgtcgatcatcgagcgggtgtccggggcgaacttcaggacccagcgggcgatcatcccgccctggctgtgaccgagcaggctgatcggcgtaccggcgatccggtggaggtagcggatgccgcgttcgacgtgcccggcggcgatccggatgtcgccgttgccgctgtccggcaggtcgatgtcgcagtgtgcgcgaccttcgtggtcgaaggcgcggtcccagttccaggagaagttcgcgcgggagttcgaggtggtgccgtggatcagcaggatcggggtccggccgttcgccgggtcgccggtgcagtgcagatccgcgggctgccggtgtgccggtgccggcacgagcagcagggcggtggacagcaagatcgcgaggctcacgtggacggcaacgatccgcccgcgccttcggttgccggatccgctccacgaacccgaaattgcccaccagggcggcgcaaccgtggcgaggtgcccgtcccgcgccggaatccggcccggtggggatgaccccaccggaatccgggggccggcccggtgtcggtccgcgcgcgaccgccgtaacttctctgctgtggacaagggattcgccgtcgtgcgcggcctctaccggtgcctgcggctggcggcgctgaccgcggtgctgccgctggtcggcgtgaccgtcgccgggggcggtgcgctgttcgccggcacctggacgcacggcaggcacctgtcctggccgctgcgcaccctgatcggcgccggacaggtgctgatcgtggtcgtctgggtggccgccgccctgtggatcacccacctgctgaccagccgtccgctcgccgggtccgcccggcgtctggccgcccgctggctggaccgcgacctggcggtcacctaccacccgccggccccggtcacccggatggccaccggcttctggtgggacggcagggagtatcacaagacggagcgcgaggcccgccgccgctccgccatgcacgcccgcttccacgatccgcaggtcaccggggacggcatctgggcgctggccgccggcgtgaccgtcttcccggtcaccgtcctgccgccactggccggcacggccggcctgctcgcggccctcgtccggcccgcgtcgtggggcgccgtcgcgatcccgctgggtgtcgtgctgatcctcgccggtggcgcggccgccccgttcgcctggcggatcttccggccggtcgccgaccgcttcctcggccccggcgcccgcatccgcctcggccgccgtgtcgccgagctggagactctgcaggccgacctgaccgagacccaggccgccgagctggaccgcatcgaacgcggcctgcacgacggcgcccaggcccgcctggtcgccatgggcatgtccatgcaggccgccgagcgcatggtcgacaccgacccggcggccgccaaggccctgctcgccgagacccgggccgcctcccgggccgccctggccgagctgcgcctcctggttcgcggcatcaacccgcccgtcctggtcgagcgaggtctcgtcgacgccctgcgcgccctggcgctggatctcccggtcgcgacggaggtgaccgccgccgtcccggcccgccccgaacgccccctggagtcggccctctacttcgccgtcgccgagctgctcaccaacgtcgccaaacacgcccacgcccggcgggtcacggtcgacctggcacatgccggccggacgctcaccgcaaccgtcaccgacgacggcaccggtggcgccgcacccgcgcccggttccggtctgcacggcatccagcggcggctggcggccttcggcggcacgctggagatcgacagccccatcggcgggccgacccgcgctaccgtgtcggtgccatgcgtgttgtgatcgccgaagacctgttcctgctccgtgacggcctggtccgcctcgtccaggcctacggccacgaggtgacggccgccgtcgacagcggaccggccgccctcgaagccctgctcaccgagcgtcccgacgtcgccatcctcgacgtccgcctcccgcccaccttctccgacgagggcctgcaggcggccctggcggcccgccgcgagatccccggcctgccggtcctgatcctgtcccagcacgtcgagcagctctacgcccgcgagctgctcgccgacgcgcggggcggcgtgggttaccagctcaaggaccgggtgctcgacgccgacgacttcatcgacgcgctgacccgcgtcgccgccggcggcaccgccctggacccggccgtcgtcgccaagctgctcggccacccccgccgcgccgaccccctggccaccctgaccgagcgggaacgctccgtcctggccctgatggccgagggcatctccaacaccgccatcgccacccgcctgttcctgagcgagggcgccatcagcaaatacaccacgaccatcttcgccaaactccacctgcgccccgacgacaacgacaccaaccgccgcgtccgggccgtcctcacctacctcgccgcggaccgcccggacgactgacgcgaccagccgcgctctacggcgttctgcgtgaggtcgtgaccgcgctccggcaaggaacggccatctcggtcgttgcgcaccacacggcgctgaccacgcaggcggccgtggatctggcgaccatctcccggccggcccgggtccgcatggtgtgcgggagcggcaccggatggtcgcgccgccgcggtccgggccgaagctttcccgccggaggatgccgcatacggtgcccggcatccctggcctgctggaacgaaggtgagtgcccgagctcgcggccggagtgcgtcgtcattgcgctccggatgcctggtagggctcgtccggatcagcgtcggcccgccccggccgggcggttggcgccacacgtcgggcatcggggacgggcggggggagccgcggtggtgcggtgccgcaacgcggtggctgcgatgagcaggacggtcagggcggcgacgatgacgaggaccgccaccgcggccatggaactccaggtggggttggggacgttcgcggcggtgccggtgatggccgcggtcagcggatgaatggccagcagggcgatcggggcgggcagcgccagcagggcctgggcgccccggtggtcgccccgggccgacagggtgaaggcggtggccagggcggccgtcagcaggatcgtgccggccgcgggaagttcgtggtcggcggccctgtagtagatcatgaaagggtcgaggtacgggccggcgagcaccccggcggccagggcggtggcggtgatcgcggcggcggcagcggccgggagcaggcggacggcgagccggccgcgaccggcaccggccagggcgagcaggccgagtgcggcttgcggaagcaggacgaagagcggcggccggagtcgggcgagaaggtcggcgagcggcgcgatcccgaccgtgatcagcagggccgcgatgaccgccggacgtgcccatctggccggggcggcgacgtgcacgacggacgcgagcagccacgacgcccagaccaggatgccgatcgaggtgaatgtgcccggccgggggtcgtcccaggcgaaacggcggacgagttcgacgacggaccagccggcggccagggcggtggcggtgatcatggcgaaggtgccggccaggcggaagccgggtgccaggtcggcgaggccgcaggcgcggacccgctcgcggaggccgccggtgaccaggtcgacggtgtcggcgagagtgggacgacggcggtccggggagaccgagtccaggtaggtgcccaggatctcggtgccgcgcgcccggcggtaggcggccgggtagcaccagtggatcagccgggcgtaacggcgttccagatcggtcatgcccagcctccgaggcgcagagcggtgccgggcgaagcgaggctccggccgaaggtggtgcccggcgtgcggcggccccggcgggcgggcgacggggcgagtcggaggcgggtggtggcggcttcgacgttgcggcgcatgcggtcggtctcctcggtgagcagggtggtgccccggtcggtgaggcggtaatagcggcgcagccggccgtcgacggtctcctcgcggtcgacggtgatcaggccggcgtcggtgaggcggtccagggcgccgtacagggtgccggggcgcagcgtgatgcggccctcggagaggcggctgacctcggcgaccaggccgtagccgtgcaggggctcgccggccagggcggtcaggatcaggaacgtcggttcgcgcagaggcgtttccacgccccgcaatatatcggctgcgaaggtatgccgtcagcccgccgcccggggcgcggcgcggcgctagctagctagggcgcggggtcagggggcgggcagctccaggcggacgacggcgccgccggggccgccctcggtgtggaagccggtggcgatctggcgggcgatgtccaggccgaggccggtcgagtcgccgcccgaggcgccgcgggtggtggcggaggccgggaagccggggccctcgtcggcgaccgtcagggtcgcgccgccgcccgggcgggcggtgagggtcaccgcgaacggggtctcgtccggggtgtgcgcgaagacgttgccgagcaacgcgtccagggccgcggccaggtcgtcggcggcgaccgcgaccggcaggggagtgtccggaagtgatcgggtcaccgggcggccggtgtcctcggcgaggacctgccagaaggcgacccggtcgctgaccaccgcggtggcgtcgcaaccggccggctggtgggtgacctcgcgccgggcctgctggatggccgcggtgacggcccgggcgacgccgtcggcggcggccgcgacccgggcggattcggtcggatcctgcagggattcggcttccaggcggagggcggtcagcggggtgcgcagacggtgtgagaggtcggcgatccgttcccgttcggcggcgagcaggtcctggatgcgggtcgccaggtggttcagggcgccggcgacctcgcgcagctcgggtgggccggcgggggcggcgcgggctgtgagttcggcgccggccaggcggtgcgagaccgcgctgagctgggtgatcggggcgatgatggtgcgcgccaggcggtcggcgaccagcaggccgagcagcagcagggcggcgccgaggccggccagggtgagccaggagcgggagacgccgcgggtcaggtcggcatcggcgacgacggtccggatgacgctggtgccgcgggcgccgaccacggggacgacgacctcgcggccggcgggggtgctgaccgtgaacgattggcctttggcggcggccagccggaccgcgggggtgaccgtggccggggcgccgaccacggtgccgtcccagtggaagacggtgaccggcacggcctgcccggtgaccgcggtccgcaacgccgggacgtcccccacggcgaacggcacgatcgtgcggaccaccgtgttggcctggctcagcgcgcggtcctgggcgacctgacgcagcagcagcgcgatcggcaccagaaaggccagcagcaccagcaccgtggtcgccgcgaccagcagggtcagccgggccctcacgccggctcgctcagcttgaccccgaccccgcggacggtgtgcaggtagcgcggttcggtcgcggtctcgccgagcttgcggcgcaaccacgacaggtgtacgtcgacggtcttgtccgccccgccgtacggcacctgccacacctcgctgagcagctcccgtttcgtcaccacctgaccggcccgcgccgcgaggtggtgcagcaggtcgaattcgcggggcgtgaggtcgaccccggtcccgtccagggtgacctcgcgggccgccacgtcgatccgcagcccgccgacgaccagggccggttccgtctcgccgggggtggcggagccgcgccgcagcacggcccggatccgcgcgtccaactgcgccgcggtgaacggtttcaccacgtagtcgtcggcacccgcgtcgagcagccggaccatctcggtctcctcgtcccgggcggtcgcgacgatcaccggggtccggctgaccgcgcgcagcatccgcagcagctcccggccgtcgaggtcgggcaggcccaggtcgaggacgatcaggtccggtcgttcggccagggcggtctggagtcccgccatcgccgcgggcgccgcggccaccgcgtgcccacgatcccgcagggcgcgcagcagggtgttccggatcgccgggtcgtcctcgatcaacagcagtctcgccacggctgcacggtatcggctgggccgggccgcccgggcggttcttaaccgtcccttatcccggtcccggcggcggcttagcgatcccgggcgcatagtggcccggtgagccgagtgggacagcgtgtggtgatcgtcgcggggtgggtggtcgcggcggtcctcgccgtgctcgtcggggtggtcgggatcggcctggtcggggccggcctgacgaatcgggaggcggacaccgcgcgcagcgaggcggacgtggagcgggaactcgcgcaggccgggccggctccgatcccgacgtcggcgctgcccaccgcgtcgccggcgaccgccgccccgacgaccccggtggtgtcctcgttcccgacccggggcggcacggtggtcgccgactgcgacgggatcacctcgatgtccccggcgcagggtttcgcggtgcacgagcagagtgcccgcgaaggggagttccgcggcgtgcgggacgaccacgtccgggtgaaggtgcggttcgcctgtgtgaacggcagtccgcgggtggtcgaggactgagggccggccgcggtgttccggcaaccggcgcaccgcccgggtgccgcgcgatcggatcgcgtcccgggattgatctaccctgtctgccgtgccaggaccatcgctcgccgccgtcgcccgacccgcgaccgacatggacgccgaccggatagcggagatctgcacggccgcgtatcgggctgcctaccgtgagctgctcccgcccggctacatcgagcggaccgccggcatctgtttcggcgcggcccgggtcgcgcgtcaggtgccggccgacccgccgcgctggttcggctaccaggtcgccgaggagggtgaccggctggtcggcgcggccggcggcggcctgacccggcccgggatcggcgagctgcacctgatctatctggatccggcggagcgcggccgcggactgggcacgctgctgctggaccgggtgatcgcgcagatccgggaggccggcggcaccgaggtgtggctgtcggtgttcctcggtgacggccccgggatcggcttctaccgctcacgcggcttccagccgatggcgaccgtgcaggccgatctgtcccgagaggacgatcacatccgcagcctgcggatgcggcgcgcgctgcgataatcctcttcccgccggccggtcgccccaggcaggatgtcaggtgtgcgacggggacccgggcgttatctgtggtggctggccgggcaggtcagggggcggctggcgctcggcatgacgttcggctcgctgtggttcttcagcctggccgcgatgccctggctgatccagcaggcgatcgaccagggggtcacgccgcgccgacccgggccgctggtcgcctggtcgttcggggtgctcgcggtcggcctggcgaatgcgatcctcggcatcctgcgccaccgcaacatgacccggctgcgggtcgacgccgcgctgcgcaccgccgacctggtgctcacccacgcggtccggctcggtgccgcgctgccccgtcggatcaccgcgggcgaggtggtcaccatcggcatctccgacgtgtggcagatcggccgggggatgaacgtgggcggtgtcggcgtcggctcggtgctggcctgcatcacgatcggcgtgctgctcggccacaccgccccgatcctgtccctggtcgtgctggccggggtgccgctgctcgcgctgctggtcatcccgctgctggccggcactcagcgggccggctcgcgataccgggagcgacagggcgcgctgaacgcccggctggtcgacgtgatcggcggcctgcgggtgctgggcgggctcggcggcagtgccacccacctggagcgctatgtgcgcgagtcggcccggctgcgcgatcagggctaccgggtgggccgcccgtccagctgggtgaacgcgctcggcgacgggctgccgatgatcttcctggccggggtggtctgggtcgccgcccggatggcggtgaccggcgagatcaccgtcggcgagctgaccgcggtctacggctacaccgcgctgctggtcatcccggccagtgtgctgatcttctgcggcttcgatctggcgtacggggtggtcggcgcccgccgggtcaccgccttcctgcgcctgccgctggacgacccggccggcgacccgcccctagctagctagggtcgccggccgccacgacccggacgacgacctgatccgggtcgcgatcgacaccgcggtggcgcacgacgtggccgacgacctgggccggcacgtcgaaggggacggacgcaacctctccggcggccagcggcagcggctccggctggcccgggcggtgcacgccgacccggagatgctgctgctggccgagcccacctcggcggtcgacgcgcacaccgagtcggccatcgccgaacgcctggccgccgcccgccggggccgcggcaccgtggtcgccaccacctcgccggtgctgctcgaccgcgccgacacggtgcactacctggtcgccggccgggtcgccgccagcggcacacaccgcgagctgctcgacaccgaccccggctaccgcgccctggtcacccgcgtgttcggcgacgaccggtgagcgccgccctgccgatcgccgaccagcggcaggtggcccgggccgcgctcgctctgatcgccgccgacaagcgctcggtcgccgcgatgaccctgctgaactcgctggccgcgctcgccggcctcggctcgccgtggctgctcggccgggtgatcgacacggtcgccaccggcggcggggtgcacgcggtcgaccggctggccctggccgtgctcggctgcgcgatcgcccaggtcctgctgtcccggttcgccctcgcactggccttccggttcggcgagcgcacctcggcccggatccgggagacgttcctgcgccgcgcgctgagcctgcccgcctcggtggtcgagcgggtcccggccggcgacctcgcggcccgcggcaccaccgacgtcgacgcggtcgccaccaccctgcgcgacgtgctgcccaggatcctgatcggcctggccgagatggtcttcatcgtggtcgccgtggtgctgctcgacccgctgctcggcatcgtcggcgtgctcggcctctccggcatctggttcgccacccggtggtatctgcgccgcgcccgggacgcctacctgcgcgagggcgagtcgaactcgtggctggccgacgagctggccgcgaccacctccggcgcccgcaccgtcgaggcgttcgggctggccgaccggcggctcgcggccgggcacgcggcgatcgacgagacccgccgcacccgcctgttcacactccgcctgcgcagcgtgttcttcccggtcaccgagaccttctacgcggtgccggtgatgctggtcctgctgctcggcggctacctctacctgcaccaccgggtcagcctcggcaccgtcggcgcggccgtgctctacctgcggcagctgatcaacccactggacacgctgctgatccggatcgagcagctgcagtcggccgcggcgtcgttcgcccgggtcgagggcctggtccggatcgaggcgccgccggtgatccgggaccgcacgccggacggcgaccggatcgaggtccgcgacgtgcggttcgcctacgactccggccgcgacgttctgcacgacatccacttgaccgtacgaccgggggagcggctcgccgtcgtcggcctgtccggggccggcaagtccactctcggccggctgctcgccggcgtcgaccggcccaccgcgggcaccgtcaccgtcggcggggtgccgatcgccggcctgccgcccgagctgctgcgccgccaggtggtcctggtcacccaggatcaccacgtgttccgcgagtcgctgcgggacaacctgatggtcgccgcgccggacgacgagctgcgccgggcactcgccacggtcggcgccacctgggccgacgacctcgaccgtgacctcggcgcgcagccgctggacggggcgcaggcacagcagctggcgctggcccgggtgctgctagccggcccgcacacggtgatcctggacgaggcgaccgcgctgctcgacccgaccgccgcccgcgacgcggaacgggcgctcgcggcggtcctgcacggccgtaccgtgatcgccatcgcccaccgcctgcagaccgcacacgacgcggaccgggtcgcggtgctggacgacggccggatcatcgaactcggcacgcacgacgagctgatcgccgccggcggctcctacgccgcgctgtggcggtcctggcaccgcgccgatcagatgcggtagtacggatatccggggtacaggtagccgccactccagaacggcgcgtacccgtagtgccggtacaactcgttgtagtactcgctcgcgtcgatcagcgccgggtcgtaccgcggcgcctcggccacgatctgcttcggctcgctcacgtgcaccacgtcgtcgtcgatcgcccggatcgcctcgatcggcacgaacgacgaggtcgcgccgaagccgagaatcccgccgtgcgccacgcacagcatccgcacccggtgctcggccgggtcgatcagcaggtcgtcgacccggccgagctcgtgcccgtcccggtcccgcacctgccggccgcggacgtcctcggccgggtcgccgaccatctggtcgctgtcgctcagcctcaccagctcgatcccggtgttcggcgtcgtcatccccgccacccttcgtcgctcgccatcgcgtcgtcggccgccatcgcctcgccgtcggcgccccccgcctcgtcgctccgcatcgcgtcgtccccccgatcgcgtcgtcgcgggaagatcagcagctacggatgcggatacccgatccgtccgtctcgcaacccgactggcaccgccggggcaactggtgcaggctgggcccatgggatggacggtgcgcaagcagttgctctgcccggcctgcggcgacgtgctcgccgacgccctccaccgccgtttcccggcccagctgatgctccgggccccggccggctgggagatcatgccccgccgcagcgccgccgtcgaacgcgaactgctcgccggcgacctccccggcgacccggaccgcgccaccctgcaggccatgctgctccgccaccacgccgacctgatctacaccctgacctgcccgcgcggccacgtcacctaccgcgccgcccccgacctggtccgggcgctgcgcaccacccccggaaactgggtcaccccggcctgagccgccgggtcgccgcggatcagctccgatcgagccggaccggggccgccccgctcggctgaatgtcgctattcgcggcctgctggaacggcacgtcgcggtagttaatgtcaattcgacattaatctagcgtcgaagcgccctggcgatcgagatggaagccgccggcgtcgccaaggccggccacctgaacgcggcgccggtcgcggtgatccgcggcatcagcgacttcgccaacgggacgaaggccgccagcgacggcgcatcctggcagccgcgggccgctgagcacgccgccgccttcgccgccgccctggccgccgagatcaggccgaggcggacggccgcaccgtcggctgcccggcaggcggagccggtgacggtggagaaccacaacaccgtcaccggcaacgcgcgggtcggcatgcaaggcggcaccatcgccggggacgtccacttcggcgccggattctgggacgacgcgacggggagcggccggcgatgaagtcctcggacaacaggcccccgaccacgaccaccaacaaccatgcgggtgacaacgcccgggtgggattccagggcgtcgttcacggcgacctgaaactcgtggtgccgccggatgccagcccggccgagaagttccaggcggccaaggcgcatctcgacagccggtcgatcaccacggccaggaaactgatggaggaggtcgtgcatgccgggcacacctccgcggagatctggttctactggcttctggcgtacctgagcaggcgtacgctccgcgaactgtcccccaccgagcgggaccgcctggagaaggcgcgcgagaccgccgccggcgtgcccggagccgaccggtggacccgggggatccgggtcatcggccaggtcctggatgccgccgagtcgggggccggccagtccacgtcgatcacggaatgcctgatcggcctggacgacaagccacaggacgagatccatcggcacctcggcctgctgttgcgcgacgcggtccgcaacgacgtgtggcgccaggacatcgcctcggcgatccgcaggcagcgagccgcgaaccgggagaagcgggtatggaagttcttcgagccggatccgcgggcagctcgggtgtatcccctcgcagaccggcccagcgacgctcagatggccgagtggctggactgcgatgttcaggtcctcctggaccagacgatgagccggtaccagctccgcagggacgagatccagacgtatgcctcgctggaggcgcccgggccgaactgccggaatgcccggatacccaacgggccatggcgctattcgacgtaccggatcgtagtttttctactgacccgtgaaggcgtccggcagatcgaggtggatctgagattcgcgcaggggaccttccacagttggaatcgcatgaactaccggttcgaggcggtcgcggcggtccgggtggaggagggcgacgacggcgcccgggacttcgatctctcgctgatcagcggcgagaacgtcgaggtgcgggcgaccgattccacccaggcggacccggcagtcgaggatccgcggatcgtggcggacgcgtcgatggacgcggcgggcctgcgttccacgctgttcatgctggagggtgtcgccgcggaggggcgggcctggtggcatgcgcgtcatccacgctcgtcggatccggacgacgacccggtccgcaggatgggtgggaagagggagaccgccgagccgcgccggtagaggatggcggggcgccccacgtcggcggcacgtttcgctccggtcggcacgacgaaaccgctggtgtgcatgactttgcggttgaagttgcgcggatcgaccggggcgccccacaccgcctcgtacacggctcgcagatcgccgatggtgaacgatgacccgcagaacgcggccgccagggtggtgaactccagccgggtgcgggcccgctccaccgcgtcggccaggatgacgtcgtggtcgaacgcgaggccggagcgggcgcggttgaccggcatccaggccgcgctgctcgcgtccgagccggcggtcggcaacgggagatcgggcatgacggccagataggcgacgctgaccacccgaccgcggggatcccggccgggtgcgccgtaggcggccagttgctccagatgcagtgtcgttccgtcgaggccggtctcctcgccgagttcgcgtaccgccgtgtcgtggatgtcctcaccgcgccggacgaagccgccgggcagcgcgtgacgaccctggaagggctcgttgccccgcgtgatgatcagaacctggagcccgccctcccggacggtgaggatcgccagatccaccgccaggcgcagccgctcgtgttcccggtcgatcaccggcggcgaccccagcgcaggtaggcgagggggccgaacggctgcacggcgggggccgggagccaggcgagtttgcggccgcggacctggacgccggggcggcggatcaggtcggcgagggcgacggtggtgaccacgagctcggcggcggccagcgccatgatcgcgcgttgctggccgcggctgaggtcgctccaggatttcttctccggcatcaccctgttgtaccggagccggggacgcgacgggtccccggctccggtgtggatcagagcagtccgcccatgcccgggtcggtgatgctgtcccgaccgttctccaggtgcccggcgtactgctggacggtgtcacccacggtgatggtcacgtcgtaccagccgcgggttctcgtggtgttgatctgcgaggtgcgggtggtgccgccgcgcagggtgagcgtcgacgcgtgcccggtgtaccgatccgaaacggtcacctcggcgcggtcccggccggtgttccggatctccaggaggaccgtgtcgtggtgttcgacgtaccgcgcccgggtttcgatcggggaggtgccgcgccggaagcggcggtagaagccgttcggaccgtgcacctccacctcggcggcggtgaagtcgccggtcaggtgcttgcccggttcgacggtgaaggacaccgggtcggcgcccgagggccggacgtggaagaccgccgtggcccggccgacgttgcgcagcaccagcgtgtcgccggtgagatcggcgtgcagggcgtagggcagggcccgggcgggacgtacaccgcgctcctgccggggcagtctcgcctcggtcggtgggaccgggaccaggtcgggctgccgggtcaggtcggacggtttcagcgccgcggtgtccggcaggtccaccggccgccggttcggcgtgcggaagtcgaaagcaccggtcaggtcgccggccacggcccgccgccagggcgtgatgttcggttcggtgacgccgaagcggcgctccaggaaccggatcagcgaggtgtggtcgaaggtctgcgagttgacccagccgccgcgggtccacggtgagacgacgatcatcgggacccggatgcccagcccgtacggcccggccggatgcccggccccggtgaagatctcgttgaccgtggagacggtcgaacgggccgggtcgggggtcggcgggatcaggtggtcgaagaagccaccctcctcgtcgtacgtgacgaacagcgccatcttcgaccagatcgccgggttcgacgccaggatgtcgatcacctgcgagatgtaccaggcgccgttgtgcggctcccagttcgggtgctcggtgtacgcctccggcgccacgatccaggtgacccgcggcagcgtgccattctccacgtctgtgcggaaatcggtcagcagtcgctccggggcgcggccgagtcggttcacctcggtgccggtcttcgcccggtccgccagcgggtcaccgggctgcgcgttctgataccggtggaagtagagcagggcgttgtcaccgtagttgccgatgaacgggtccgacgtccacccccaggagccggccgcggtcagcccgagccccacgtcctggtagaccttccacgagacgccggccttctccaggcgctccgggtaggtggtccagtcgtaccccgcctcggcgttggtgatcaccgggccgccgcccgtgccgtcgttgccgacccagccggtccacatgtggtaccggttcgggtcggtcggcccgagcagcgaacagtggtagttgtcgcacaccgtgaaggcgtcggccagcgcgaagtggtacggcaggtcggctcgggtgtgatgggtcatcgtctcgacacccttgttcggcacccagccgtcgtaccgcccgccgttccacgcgccgtgcgtgtcgtcccagccgtgcggtgggtccgggaggaacgagccgcccaggtccggcacatccggccggaacggcagcagttcaccgtccccgttgcgctgatgccacacgctcttcccgctcggcagggtcgccggatgcggatcggcgaacccacgcaccccgcgcagcgtgccgaaatagtggtcgaaggaacggttctcctgcatcaggaagatgacgtgctccacgtcctcgatcgacccggtgcggttgttcgccggaatggcgagggccttctccagccccgcgggcatcgcggcggccaccgccggcatgcccagcatctgcaggaagcttcgacgatccacgctgctcacgccggggaacctagttactccagatggactcgacatgacattcaagagtaccgattgatacgccccggctaaactgcccgccgtgcgctggtggcgggggctccgaccactcctgatgatctattcgccgtcgccgtcgccgtcgccgtcgccgtcgccgtcgccgccggccaggccgtctcggcggtcgcgggccaggcgatcccgtcactcgcggccggtctcctggtcgccaccgcgacgattgcccggtacgcgtacctcgcccgctgcccggagcaacgcgaaaccaccgatgtgccacgcgccggccgattctgatcgaccggccgtggtgtcctcgcgacatcggcgtgctcaccgtcgcactcccggccatcgcgaccgcggtggcttccggatgagggcgaactagcctcctaggatgcctaagggtggtgatcggtgcggctcgcgccggcaagagcgacgagagcggcggtcgtggcgcggcggcgggtggcggaaagcggtttggtgtgggtagcgcggtcgggagaggatcgcagcgtgagcgagcgcggagagcgtgccgggcggttacgggtggagctgttcggtggtttgcgggtctgccgggatgaagcggatctggcggtgcctggcgcgcggcttcgggggttggtcgtgcggctcgcgctggcagccgggcggccggtcggggccgggacgctggtggactcgctgtggccccgggagcggccggcggatccggcgaacgcgctgcaatcgctggtctcgcggctgcggcgggtgctgggggacgccgaggcggtggcgcaggacgagggcggatatcggcttcgggtcggcgacgacgatgtggacgtggtgcggttcgagcgactggccgggcaggggcggcagcggctgcgggccggggacgcggtcggggcggcggagctgctcggggcggcggtggcgctggtccggggtgggatcgcggccgaggtcggggtggtggccgcggcggtcgggctgcggctggagcggtcggtgggggcggcgttcgccgatgtggcggagagcgatctgctgctcgggcggttcgacgcggcggaggggcggctggtgcggctgctggcggaacatccgctggacgagcgtgtcaccgcgctgctgatggacacgctggcggcgcaggggcggcaggcggatgcgctggcgctctacgagcgggtgcgcgaggaggtggccgagcggctcggggccgatcccggtgcggcgctgcgcgagcggcacctgcgcctgctgcgtggtgagtacggcgacggcacgcgcacgaccggcccggtgggtgcgggccgggccggggtcggacgtggcggctcagcggaagccgaggctgccggccaggcggggagaggtggcggagtctcggccggaccacgaggagccggcgaggcaggggcggggagcgccgacccggtggcaggtgggggtgcccgcggtgtcgggcgggccggcggtggcgccgggcgcgatgcggcggttgacggtgccgctgggcgggcgggtggcctcggcgtaccgggcgatggcggaccggaagaagagagggaacagggcggtagcaaccttccggaaccgttgacgagcttcatcggccgtgaggccgatctggcgcggctcgatgacctgctcgcggccgggcggctcgtcaccgtgctcgggcccggtggggcggggaagactcggctggctacgcaggcggcgcggcggcggcggggggagttccgggacggggtgtggctgatcgatctggcttcggtgacggcgtccggggagttgccggcggcggtgctgacggctaccgggctgcgggcggcggcgatcttcgagggtgggttgcggctggaggggcgcggggacgtcgatgtgctggtggatcagttcgcggggcgggaatgcctgttcgtggtggacaactgcgagcatctgatcgatgcggtggcgcatctgacgacggcgctgctggtgcggtgtccggggttgcggatcctggcgaccagccgggagccgctggcggtcgacggcgaggcgctggtgccgctcggaccgctcggcctgcccgaacagacgccgccgggacatgcggcggccgggcaatcgccgtcgggacatgcggcggccgggcaatcgccgtcgggacatgcggcggccgggcaatcgccgtcgggacatgcggcggccgggcgatcggtgcctcagccgccggcggcggtcgagggcatggacggtgcggtggagcgggcccggcgggcacccgcggtgcgcctgttcgcggagcgcgcggcggcggtgctgcccggtttcgcggtggaccggtcgacggtggcggatgtggtgcagatcgtgcggcgcctcgacgggctgccgctggcgctggagctggccgccgcccggctgcggacgctgggtctgcgggagttggccgacggcctcgatgaccggttccgcctgctgacgacggggagcaggacggcgctgccccggcaccggacgttgcgcgcggtgatcgcctggagctgggagttgctggccgaggacgagcggatcctggccgagcgggtgtcggtgctgcccggtggggtgacggccggttcggcggcggcggtgtgcccgcaggtgcgggcggcgctgatcccggatctgctggccgcgctggtggacaagtcgctgttgcagcgggcgccggacggccgttaccggatgctggagacgttgcgggagtacgggatcgaccggctggcccagcagcacgcgctggtggcgacgcgggggttggcggcgcgtcacctggccggcgtggtggccgagcacgatccgcggttgcggaccgccgagcaactggacgcgttgcgggtgctgcgggccgagtatgacaatgcgctggccgcgctgcggcatctgtgtgacgagcgggatgcggacggcgcgacccggctggcgttgagtctggtctggtactggcagatgttcggccggcatgcggatgcggcgttctggctgcacgaggcgctgagcctgccgggggagcgggatccgctggtcaccgacaccgcggaggcggtgctggcgctgaaccgggtcagtgcggaccgggtgatggtgacggagacggcgcagcagcggcaggatcggctgcgaagtctggcggtgcggctgaaccggcatgccgagctgcccgggatggtcggcgcactgtccacggtggtgctgttcatggcgcaggaggaggcggcggcgcaggagcggatggcgcagctggtgtccggtccggatcagtgggtggcggcgctggcccgattgttccgggcccaggtggcggagaacaacggggatgtggcgcaggtccgggtggatgtgacggatgcgctggccgggttccgggcggccggggaccggtgggggcaggcgaccacgttgccgctgcgggccctgctgcggcagtacgagggtgatctggacggcgcgctggccgacctgaccctggcgaaggcgctggccggcgagttcggttcgctcgacctcggcgatgagatcttcatcgatctacgtcgggccgacctgcacatgcgtcgcggggagccgcaggaggcgctgatcgcggtgcaggcggcgcggctccgggcggcccgggcgatgacgccggagatgatgctgctgatcgatgccctggaggccggcacgatggtcggcatgggggatttcgcccgggccgaggagctggtggcccgggccgagggtggcctgtccggcgggccgggcggcttcttcgacggcgatcacggcacggcgatcgttcagacggtgcgggcgtcgctggcgttgcaccacggtgatccggtgcgggccgaaaaggcgttgatcgcggcgtacgcggcggcacagcagacgcgtgacatgccgatcctgtcgatggtggcggtgggcgccgccgggctggccgatctgctgggccggcatcgggaggcggcgcagctgctgggggcggcggcccggttgcgcgggtcgcacgatccgaccgagttgcaggtggccgagttgacccggcgctgccgggcggcgctgggcgaggacgggttcagcgaggcgtacgcggtgggctggacgatggatccgcacacggcgctggcccgggcggacccgggccagctgcgtgcactggaaggtcaggcgcgcttgttgtaggcgcgcagtgccagtgggacgaagaccaccagcaggcacgccatccaggccagggtggcgatcaggtggtgggcgacggggccgccggtgagcaggccgcgttccgcgccgaccaggtgggtgatcgggttgaccttgacgaaggcctgcagccagccgggcagggtctcggtcttgacgaacacgttgctgccgaacgagagcgggaagacgagcaggaacatcacgccctgcacggcgcccgaggtgcgcacgagcatgccgacgaagaccgagatccagccgaagcagaggccgaagccgatggcgagggcgaccgcggccagggtggcttcggcgtcggtctcgatccggaagcccatcaccgtgccgatgcccagggtgaccacgcagaccgtgacgtaccggatgatgtccgccatgaccgcgccgaccaggggtgcggaccgggagaccggcagtgaccggaaccggtcgaagacgcccttctcgatgtcggcgttgaggttctggccgagcgcgatcccgcccatcgccagcgactgggcgagcatgccgggcagcaggaactgcaggtaggtgtgccggccgccgacgccggcgatggcgccgccgaacaggtaggtgaacatcagcaggaagatgaccggctggatggtcacgtcgatcagggcttcgggggtgcggatggtcttgatcaggctgcgctgggccagggcggcgctgtgccggatcagggcgaggaaggggccgccccgcgcgtgatcggtgtaggtcacttcgtccaggaccgccgcggtcataccaggacctcatccttcttctcgccaccggtcagggtgtggaacacctcgtcgaggctgggcaggtgcaggccgagctcgttgacctcgatgccggcccggcgcagtgcgggcagcacgtcgtcgagcgcggtgtcggtggtcaccgggaccgaggcggctccgggccgggagccggccgtggcgtccggcgcggcggtggtgccgggcgaggcgaccgcgtcgaggatgcgcagcacgtcgggcagccggcccgggtcggccggccggatccgtagggtctgcccgccgacccggcgtttgagcccgtccggggtgtcctgcgcgatcacccgaccgtggtcgacgaccacgatctcgtcggcgagtgcgtcggcctcttccaggtactgggtggtgagcagcacgctggagccctgcgcgacctgggtgcgcacgacaccccacatgtcttcgcgcttggccgggtcgaggccggtggtcggctcgtccaggaagatcacctcggggtggccgacgaggctggcggccaggtcgaggcggcggcgcatgccaccggagtacgttttggcggggcggccggcggcctgggtcaggtcgaaccaggcgagcagttcggtggcgcgcttcttggcgtcgcgggtggtcaggtcgagcagccggccgatcagcaccaggttctgggtgccggtcagatcctcgtcgaccgacgcgtactggccggtcagcccgatccggcggcgcaccttctgcggttcgcgcaacacgtcgatgccggccacgtacgcggtgccctcgtccgggcgcagcagggtggccagcacccggaccgcggtggtcttgccggccccgttgggtccgagcacgccgagcaccgtgccgcggcgcatggccaggtccaccccgtcgagcgcctgtgtcttgccgaagcgtttgcgcagcccttcggcccgcactacgagatcgtccacgatcgtccccctcatccgtctacgggacagagcgtgggggagggcgctggcatgatccgcacacggcgctggcacggtggtgccagccggctgtcaggcggttcgccccggggcgccgggcggcaatggtcggaccgacctgagccaggacctcattttccctgggcggctgccgatctgaccggatgtgacgggtatgcggcgaccgccggggtgggccgcctggctgctcggcggctcggccgccgtggtcgggtacaccctgctgccgtacggctggccgcagttcgtgctgtcctggctggtcgcggtgagcgcgtgcgtgacgctggtggtcggcgcctggcggcaccaccgggagcagctggcggcctggcacgtgttcgccggcggcgcgctgctctggctgggcggcgacctgtattacgcgctgcgcgccgatggcggctatccgacctgggcggacgcgttctacctgggggcgtatccgctgctgctgacggcgctgttccagctgacccgacggcgcgggcccctctggtcgggcaacctgatcgactcggcgatcgtggcgatcagcgtcggcatcgtctactggacgttcgtgatcgagccggtgctggtgaacccggcggtgccgctgctgacccgggcggtgaccgccggctatccggcgatgggggtgctgctctgcgcgctgctggtgccgatgctgttgcgccgcggaccgcggaccgccgcgatgtggctgctcaccgccggcggggtggtgaccatggcggccaacgtggtgtacacgctgctgcccgaggtgttcgccgcgcacgcgacgctggtctacgccggatatctgttcgctgacgtgtgctgggcggcggcggccgcgcatccgggcaaggcggcgggcgtcgtcgaggaggacgacagcctgggctggggccggctgctggtgctgaccgcctcgatgctgctggtgccggcgatcctgttggtgcagggtgagctcggcgtgggccggatgagctggctgaccgtcgggatcgggtcgatggcgttgttcgtgctggtggtgacccggatgtccgggtacatcgcgcgggtccgcagtcaggcccgccggctgcacgacctggcgatgcgtgacgacctgacggggctaccgaaccggcgggcgttcgaggaggaggcggcccgggtggtggccggtggcccgtgccggctcatcatggtcgacctggccgggttcaagcacgtcaacgaccggttgggccgggccgccggcgatcaggcgctggctgcggtcggccggctgctgcgcatgtcgctgcgcgagggtgacgcggtggcccggatgggcgccgacgagttcgccgtgctggcctgcgacacgcagcccggcgacggcgagtcggtggtcgcccggctgctcgacgcgctgcgccgcccgatcgtctccggcgagcaggagctgctgctcaacccacggttcggggtggccgacagcgaggactgcggcgcggtgccggtgcccgagctggtgcgccgcgcggacaccgcccggtatgcggcgaagtcgtccggcgcccagttgatggtctacaccccggagctggacgagcgggccgacgcggccgcctcgctcggcgctgagctgcggcacagcctcgacgacggtgacttccgggtggtctaccagccgatcgtcgacctgcgcagcggccggttcgaggcggtcgaggcgctggtccgctggcagcatccggtgcgcgggttcgtcagcccggccgacttcgtgccggtcgccgaggacaacgggctgatcgtcgagctgggcgagttcgtgatgcggaccgcctgccacaagttcgccggctggcggcgggacctgggggcggacgggcccagctacgtcagcgtgaacgtgtccgcccggcagctgagcgagcccggcttccccgaggtggtcgccgcgatcctcgacgagtgcgggctggccccggccgagttgctggccgaggtgaccgagaccgcgctgttcgggggcggcaccgcggtgcaggcggtggagaccctgcacgcggccggggtgcggatcgccctggacgacttcggcaccgggcactcgtcgctgggcctgctgcgcaccgtcccggtcgacgtgctgaaggtcgacaagtcgttcgtcgacgagatcatcgcgggcgccggccgggcggtgatcgtcgacgcgctgatccacgtcagcaaggggttgcggctgcgggcggtggccgagggggtggagaccgcggagcaggcccggtatctgcgccggctcggctacgagtatgcgcagggttattttttcggccggccggtgccggatccggagttccggccggagttgcgtgacccgctcccggactacgagttcggcggcgagctcggtacgggcgaccgcccggcgttcgccgtcgaccaggtgtagcggagttcgacgaaactggtccaaccagttgacggttgatgtgtggcggggcacactgccgcgcatggatttcgatccggcgcctcgccgatccgtttccgaccacgtgttcgggcagctgcgcgacgccatcctgagcggcggctgtccggccggcgacccgctgcccagcgagcgggagctggccaccaccttcgaggtcaaccggcacgcggtgcgcgaggcgctgcgccggctgcagcagctcggcctggtccgggtcagtcagggcggcgccacccgggtgctggactggcgggccaccgccgggctcgatctggccatggcgctgaccgcggccggggacgtgctgccggtcgagagcctggcccgtgacgtgctggagatgcgggcctgcatcggggccgacgccgcccggctgtgcgcgctgcgggcgagcgacgcggcgaaacagcgggtgagtgaggcggtggaggcctatgccgcggcggtgcccgacctggccgcgatggggccggccgacctgctgctgtggcggcgcatcgtcgagggctccggcaacatcgcctacctgctggccttcaacagcctggccgccggggcgctggccgtcgggcacgtgccgccccatctgcgtaccgaggaacttctgaacgtggccgcccaccgccggctcgccgcgctgatcggggccggcgcggccgccgaggccgaggaggccgcccgcggcctgttgcaagtgaaggagatcgtccgttgattcccgccgtcgtgtacgccattccggcgttcctgctgctgatcgtcatggaggtgctgtcgtaccggttcctgcccgatgaccaggagcgcggatacgagacccgggacaccgccaccagcctgtcgatgggcgccgggagccaggtgatcggcattccgtggaaactggtgaccgccttcgcgttcgccggtctctacgtgctcagcccggtcaagctcgacccgcacgactggtgggtctgggtgctgctgttcttcgccgacgatctcgcctattactggttccaccggctgcaccacgaggtacgggtgctctgggccagccacgtggtgcaccattccagccagttctacaacctctccaccgcactgcggcagagctggacgccgatgacctcgaccccgttctggctgggtctggcgctgctcggcattccgccgtggatgatcttcctgcagcagtcgatcagcctggcgtaccagttcttcctgcacaccgagcgggtcgaccggatgtggcggccgatcgagtggttcttcaacaccccgtcgcaccaccgcgtgcaccacggttcgaacgacccctatctggatcgcaactacggcggcatcctgatcgtctgggaccggctgttccgcagtttcgagccggagggcgagcgggtcacctacggcctgaccacgaacatcaccacgttcaacccgttgcgggtggcgacacacgaatacgccgcgatctggcgtgacctgcgctcggcgacctcctggcgggcccgtctcggctacgttttcgggcgccccggctggcagcccgccgcatgagactcaccctcttcgccgccgtcgcgaccaccgagatcatcgcggtggcggcggatctgactccgctgcaatgggcgacgaaaccgctgctcgcgccattgctgatcggatacgtcggcagggcgaaccggctgagcgcggggctggctttcgccttcctcggggacgtcgccctgctgatccccggccagccggccttcctcgccgggatggcctgtttcctcggtgcccagctctgtttcctcacctggttcctgcgcctggcccggccgaagccggccgcctgcatcggctacgcggtcgtctgggccgcggcgaacgccctgctcgggacgcggctcggcgcactgcgcctcccggtcctgatctacagcctggcgctggccgcgatggccgccgccgcgaccggcgtctcccggcgcaccgcgatcggcggcgccctgttcctgctctccgacctgacgatcggggccggcgccgcgggcgtgcacctgccggccgccggggtgctggtgatgaccacctatgcggcggctctcgcgctgatggtcaccggctcggttccggccgggagccaccggcgcgaacggtacgggatggcacgttccggccggtagcgcgccggtcccgtcagcggcccgcgcggatgccgtccagggcgaaggtcagcacccggttgcgctgctcgtcgtcgacgaacgcgccggacaccagaccggagatcatccgcaggacgtcgtcgaagctggcgtcggcgcgcacctcgccggccgcccgggcccgcgccatcaggggctcacccgccgcgtacatggcgacccggcacgccgcgaacagatcggactcgcggttgagcgcgtcgaccacggcgcgcttggtcaccacgtagcccacgaaacgatcgagccaggcgcgcagcgccgcccacgggggcagctcggcggcggcggcggccgcggcgctcaactgctcgatctcctcgacgtacaccgcctcgaagagatcccgccgggtggggaagttgcggtacagcgtgccgatgcccactccggcgcggcgggcgatctcctccagcgacgcgtccgcgctgctctcggcgaagatctcgcgggcggcggcgagcagcgcgtcgtagttgcgccgcgcgtcggcccgggtcgggcggcggttggcgaccggaacgtctggcacggtgaccctcctcacaccacctccggggcaatcgggtggcgaaccggaggcacccctccgctaatctggaggcatgcctcgactttaccaggcgaccccgcgcgtcaccttcacggtgctggccgcggccgccgcggcgttcgccctcatgcagtccctggtcaccccggtcctgcccaccatccagcgggacctgcacaccaccaccggcacggtcacctgggtgctcaccgcctggctgctggccgcctcggtggccaccccgctgatgggccggatcgccgacatgatcggcaaggaccgcaccctcctggtcgccctcgccgccatcgccgcgggctgcctgatcgccgcgctcgctccgaacgtcaccgtcctgatcgccgcccgcgtcgtgcagggcctgggtgccgccgtcttcccggtctcgttcggcatcatccgcgacatctacccaccgcagcgcgtcacctcggcgatcggcatcctggccgccgtcatcgccagcggcagcggcgtcggcatcgtgctggccggcccgatcgtcggcgtcctcgactggcgctggctgttctggatcccgatgatcgcggtcaccctggtcggcctggtcgcctggcgcgtcgtcccgccgtccccggccggcggccgcggccggatcaactggctctccgccgtcctgctcgccggttggctggtcgccctgctgctgccgctgagcaagggcaccgcctggggctgggcctccggccgcacgctgggcctgctcaccgccgccgcggtgctcctggccggctggatgctcagcgagctgcgctccgccgagcccctgatcgacatgcggatgatgcgcctgcccgcggtctggaccaccaacctggtctcgctgctgttcggcgccgccatgttcggtgtcttcgccttcctgccgcagctcatgcaggtcccggccagcagcggctacggcttcggcgccagcgtcaccggggccggcctgctgatgctgccgatgatggtgaccatggcggtgtccggctcgctcagcggcccgctcacccgatgggtcggcaacaaggcccagctgctgatcggcgcggccctcggcgcggtcgccgccctcaccctggcgctcgcgcacagctcgccgtcggtcgtggcggtcaccggcggcgtcttcgggatcggcctcggcctgctctactcctcgatgatcaacctgatcgtgcagagcgtgccgcgcacccagaccggcgtcgccagcggcatgaacaccaacatccgcaccatcggggcgtcgatcggcaccgcgctggtcagcaccgtggtcaccagccaccccgggccgcgcgggctgcccgccgaagccggctacaccgaggcgttcctgctgctcgccgtggccagcgcagccgccttcctggtggcgctgctggtcccggccggccgcaagccggccgtccggccgacgccggtcacggtgcccgagctcaccccggtcgaggtctgagccgttgcggacgccgggccccggggcagcggggcccggcgccgtcctatcggtaggaaccctcgtccggctcctcggcggagcgctggatgaggtcgttcaccggctgcggctccccgatcagctcggcgtcctcggcctgctgctcgacatccgccgaacccgggccgtcggtggtcacgaactcggcgaagccctcaggatcaagatcactcatgctggtcgtatacccagttccgggcgtctgtagcaagctgccgaataattgcgttgccgggtccgcgggcaccccatacggtagtcatcaccaggcggccggacgggaaaaccgggggccggcgaaacgaacagggaaatggggtgacacgacatgtggcggatgagtgagagtcgactgcggctcccggcccagcgtgccggtcgtccccggttgtccctggccctgggtctgccggctcgtcgtgagccgatgcgcggtccggagtggtggcgaggctggcagttccgctagtcgtcgtcggccgccctcccgatcgggaccgggcggctttctttttctctcgcgggcgtagctcaacggtagagcggcagcctccaaatctgtcaggtgcgggttcgaatcctgctgcccgtgcggtgccgtttcttgaaaactccacagtggatgacacacttttgggcttgtagcgcagtcgggtagcgcaccggttcggcagaccgggggtcggcggttcgaatccgcccaggtccacatgtctccgtagctcagcggaaagagcaccagactacgaatctgggggtcgggagttcaaatctctccggggacgcttcgtggctatagctcagttcggttgagcgccgtctcgccatggcggaggtcccgggttcgagacccggtagccactcgaagaatgaatgcgggctggtgcaaccggcagcacgtccggctctggaccggaaagtgggagttcgagtcttccgcccgcagcttcgcccggatagcccaactggcaggaggcgcaccgctcagaacggtgacagtgcgcgttcgaatcgcgctccgggtacgcagggagagttggccgagtccggtctatggcggcggattgctaatccgcagtgggggttgcggcccccaccgggagttcgaatctcccactctccgcttcgtggtgggacatacgggtcgtggcgcagatgggcagcgcgctcgccttgggagcgggagggcgccggttcgaatccggccgacccgacgggtttctgccttcgtagctcagtggagagagcgcggcgttccgggcgccgaggtcgctggttcgagtccagccgggggcgcgagggtgtcatccacggtgggttttcgcaacgacgcaggcgggccggcgcccggctgcccctcataagggtggatggcccggttcgacaccggggcctgcgactcaggtggagccgcgcgtgatgagcgtggtggggagcgtggtcggcgccggcgtcggcgcgccggagagcatcgcgacgatcgcctccgcggcggacgtgccgatgccggtcttgtcctgggcgacggtggtgagtccgggagggatcagcgccgccagttcgatgtcgtcgaagccgacgatcgccacgtcctgcggcacccgcaagccggcccggtgtgccgcgcgcagcgcgccgaccgccatctcgtcgccggcggcgaacaccgcggtgggccgcggatcccggctgagcagcgcggtcatggcggcgtcaccgctgtcgagatagaagtcgccggccaccacgaggtcgtcgggcagggggcgacccgccgcggcgagggccgcccggaaccccgcgagccgttccccggccggccagttccgctccggaccggtgatggtggcgatccgctgatggccgcgttcgagcaggtgcgccgcggccagccgaccgccgccggcattgtcggaggtgatgtaggtgcaggtcggcccggtgaagcgcagatccagggcgacgcacggcacctcggcgtcgaccagcgcgagcacggccggatcgcggctgccgttgtcgatgatcaccacgccgtcgacgctgtgccgctgcaccgcgcgcaggaagcgctgccggccgaccggtccggcgctctggtcgggcgcgagcatgagcaggtgcaggccctgcgcgctgagcgcgcccttgagggcgaccaggatgtcctgcagaaacgggtgccgccagccgggccggcggtggtcggtgtcccacaccaggcccaccatgtgggacttcttggtggccagggtgcgcgccgactcgttcggtaggtagccgatctcggcggccatgccgaggacgtgctggcgggtctgccggctgaccacctccggtgagttgaagacccgggacacggtggcgacggatacgccgcaccgacgtgccaattccctgatgctggacactgcgccgtccctatgtaaccggtttcatcaccgtaacagccgggtgtcgcgccggtcaacggcagtgatcccgttacattttcgtgacttgacatcaggggcatcgatgcagtcaaacttttgactcagggccgcatccggcctggcgatgccccggccctacccccgccggttctctccacgatgcaaatttcggtgctcttctatgtcgtgtaaccggtttcatgaaaccggttacatctctcgagaggacgatctgacatgcgcctgtctcgattcctgcagatggcggcggcggcctcggccgtcgcgatgctggccaccgcctgcggctccgacggcggttccggcggcggtgccggcgacaacgtcacgctgaacgtcagcctgttcggcaacttcgggtaccaggagctctaccagcagtacgagcaggcccacccgaacatcaggatccaggagcggaccgccgactacaacgcgcaccaccgggacctggccacccacctggccaccggctccggcgccgccgacatcgaggcggtcgacaccggcttcatcgcccagatgcgcgcggtcggcaaccagttcaccgacctcgggaccgaccgggcgggcgagtacctgccgtggaagtggcaggcgtcgctgaccaaggacggcaagcagatcggttacggcaccgacgtcggcggcctggccatctgctaccgccgcgacctgttccagcaggccggcctgcccgccgaccgggagcaggtctccgcggcctgggccggcggctgggacaggttcatcgaggtcggcaagaagttcgccgagaaggccccggagggcagcgcgttcttcgacggtggcggcgcgctctacaacgcgatcatcgggcaggcgccggtcggtttctacgactcgaacgacgcgatcgtggtcaactccaaccccgaggtcaagaaggcctgggacctcagcgtgcaggcgatccaggcgaacctctcggccaagctggtggagagctcgccggagtgggacaacggcttcgcgaagagccggttcgccgccatcgcctgccccgcctggatgatggccaagatcaaggaccagtccaaggcgttcgccggcaagtgggacgtcgcgtccgtgcccggcggcggcggcaactggggcgggtcgtacctgaccgttccgaggcagggcaagcacgtcgacgaggccaagaagctggccgcctggctcaccgcccccgagcagcagtccaaggtcttcaccaccaagggcctgctgccctcgatcccgtcgctgtacgacaggccggagatcggcgcgctccaggacccgttcttcaacaacgccccgatcggcaagatcttcaccaccgccgccaagcagctccagccgcagcaccagggcccgcgcgcaggtgacatccagaccgcgattcgcgacggcctgacccgcgtcgagcagggcaaccagacccccgaccagtcctgggcgcagaccctcaaggacgtcgaccgtctcgccaagtagtccacccgtcccgccggcggcccaccgcgggccgccggccggaccggcgtctaaggatcgacaatggccatcaacgcccgactgacccggctcgacccacaaggctcgccctacctgtacgtactgccgttcttcctgctcttcggggtgttcgggctgttcccgctgatctacacgggctacgtgtcgttcaacgactggaatctgctcgacggcggcgcgcaccagtgggtgggcctggcgaactaccgggagatgctgcaggactcgtacttctggaactcgctcggcaacaccctgagcatctgggtgctctccacggtcccgcagctgctcgccgcgctcgggatcgcgcacctgctcaaccacaagctgcgggcccgcaccagcctgcggatgggggtgctgctgcccaacatcacctcgatcgtggcggtgacgatcgtcttcagccagatcttcggtcgcgacttcggcatggtgaactgggtgctcgggctgctgcacgtcggcccggtcgactggcaggcccactcctggacctcgcacctggccatctccagcatcgtgatctggcgctggaccgggtacaacgcactgatctacctggcctcgatgcaggccatcccgcacgacctgtacgaggcggcggagctcgacggcgcctcctccggccagcagttccggcggatcaccgtgccgatgctgcggcccaccatcatcttcaccacggtcatctccaccatcggcggcctgcagatcatggccgagccgctgctgttcggcggcgactacagccccaccggcggctccgaccggcagttccagaccatcgcgctgttcatgtacgaacaggggttccgcgaattccggttcggctacgcgtcggcgatcgcctggaccctgtgcctgctcatcgcgatcttcgcggtcgccaacttcctgctgacccggcgcatcgccaccgacgaggagtgagccgtcgtgaccgcactcgctgacccgccggccacccgcgccacgccgcccgccgttgcgaaacgccggtcccgccgcggtttcggcttcccacggcgcggctccgcctggacgtacgccgcgctgctggccgtcgtggccggctcgctgttcccgctctactggtctttcgtggtggcctcgcagacccgcgaggccgtctcccggacgccaccggccctgatccccggcggccacctgttcgacaacatcgcccgggtcttcgacagcaccgacttcggcacggcgctgctcaactcgttcatcgtcagcggctcgatcaccgtctcggtggtgttcttctcgacgttggccgggttcgccttcgccaagctgaagttccgcggccgtcaggtgctgctggtgctggcgatcgccacctcgatggtgccgcagcagctcggcatcatcccgctctacatgctgatggccaagctgggctggaccgaccagctggccgcggtgatcgtgcccggcctggtcaccgcgttcggcgtcttcttcatgacccagtacctgggccgtgcggtgccggacgagctgctcgaagccggccggatcgacggctgcaccaccttcggcctgtactggcacgtggtgctgccggccgcccgcccggccgccgccgtgctcggcctgttcaccttcatgcaggcctggaacgacttcttctggccgctggtggtgctgcagaacaacgccaccgtccaggtcgcgctctcctcgctggccagcggatacaccaccgactacacgctcaccctgaccggcacgctgctggccacgatgccgatcctggtcgtcttcctggtcctcgggcggcagatcgtcggcgggatcatgcagggggcgatcaagggatgaccgatccgctggcactgccggactttccggacgggttcctctggggggcggcgaccgccgcgtaccagatcgagggagcggtggccgaggacggccgcggcgactccatctgggacaccttcacccggcggccggaggcgatcgcctccggcgaggtggcctgcgacagctaccaccgctggcgggacgacgtggcgctgctcgacgacctgggcgtggacgcgtaccggttctcgatcgcctggccccgggtgctgccggcgggcaccggtcgggtcaaccggcccggtctggactattacgaccggctggtcgacgcgctgtgcgagcgcggcatccggccgttcgtcacgctgtaccactgggacctgccgcaggcgctggaggacgccggcggctggcgggtccgcgacaccgcggaccgcttcgccgactacgccaccgtggtcgcggaacggctcggtgaccgggtccaggactggatgactctgaacgagccgtactgctcgtcgatcgtcggatacgccgagggccggcatgcccccggcgcggtcgaggggcacggcgcgctcgcggcggcgcaccacctgctggtcgggcacggcacggcggtcgccgcgctgcgggccgccagtccccgggcgcgggtgggcatcacgctgaacctgtcgccgtccgtcccggcgaccggttcagcggccgaccgggccgcggccgaccggatggacctgctgatcaaccggcagttcaccgacccggtgctgggccggcggtaccccgaggggttcgcggcgatgtacgccggggtcagtgacctgtcgttccgccgggacggggatctggagctgatcggggcgccactggacttcctcggcgtcaactactactaccggatccacgccgccgacgcgccgcacacgcaggcggatccggcgctgcgcagcgcctgcgacatcggcgtgcggtcggtggcccgggacggcgtcccggtcaccgacctcgggtggccgatcgaaccgcaggggttgtacgacaccctcgccgggctggccggccggtatgcgggcctgccgccggtctacgtgaccgagaacggggtggcgcaactgcgcgaggggctgggggaggacccggaacggatcgccttcgtggccgggcacctggaggcggcggccaaggcggcggcggaggccgacgtcgacctgcgcggctacttctactggtcgctgatcgacaacttcgagtgggcgcgagggtacgggccgcggttcggcctggtgcacgtcgactatccgaccggggaacggacgccccgggcgagctaccactggctgcgcgagcggctggccgggcgcagcggataggggacggcgccgcatcgggaagatttggcccgtttcccggtgcggcgcggtcgtacattggatgccatggagctgcactggtggtcgatcgaggtgctcgacgggccgcggctctccgccgcccgctggcaggattcgtatgggaacgcgctggtcgaggccgccgtcacgcacggggccttcgagtggcagtggcaccggcacacctggggtgtgctgttcgagatcgcgttccggaccgaggaacgcttcgccgactaccgcgatctgccggccgtgcgggccgccctggacgcggtgcccgacccggtcaacggcctgctgatctatccgggccgcggcggcagctccggccgggtccagccgcgccgcccgctgcccagagccggggccggcgccgcgccgatcccggtcgagccgccccgcaccgacgtgcggctcggccccaccgagccgccggtgaccaccgcgggcgtcaccggctgagggttctcacgaggcgatgccgttacggaaggcgaaggtgacggcctgcgcgcggtcccgcaccctgatcttcgcgaacacgtggttcacgtgcgtcttcaccgtggactccgacaccttgaggtaggcggcgatctcgccgttggtgagcccggacccgatcaggcgcagcacgtccagctcccgttcggtgagaccctgcgcgcccgcgccggccgggccgggtgacccggcgggcagccaggtgagcaggcgccgctgcaccgacgggtccaggtcggcgtgcccggcggcgacccggtgcacggcgcggtgcacctcctcggccgcggcgtccttggtcaggtaaccccgggcgccggcccgcagcgcggccagcacgtcgctgtcgtcggcgaacgtggtcagcacgatcacctgggtgcgcgggtgctcggcccggatccgccgggtggcggtggttccgtcgcagtgcggcatgcgcaggtccatcagcaccacgtcgggatcgtgcgcggcgaccgcggcgatcgcctcgttgccgtcggtggccagcgcgaccacctcgacaccgtcgatcaactccagcattagctggacaccgtcgcggaccatgcgctggtcgtcggcgatgacgacgcggatgggccgctcctgggcagcgtcagacatatccggtatccctttccgtccgggccggagtcgtccgggccggtgagcagatcggcgccgatcagcgcggcgcgctcgtgcatgccggtcaggccgtacccgccgccgggcgggatgtccgccggcgccacggcctcggcggcgttaccgtgccaccccgtgtccttgacctcgacccgcagctcgtccggggtgtaggcgacgagcacggtgaccgtcgcgcccggggcgtgcttgcgggcgttggtgagaccctcctgcaccgtgcgttccacggtgagcgcctccggcggggtgagcggccagggctcgcccgactccgcgtaccgcgcatcggcgtcggcggccagcgcgcgcaggacctcgaccagcggacgggcgtcgccgcgcagcgactgcaccgcgcgccgggtctgctccaggccgtcgcgggccatccgctgggccaccaggatccgttcccgggccggctccagggcgccgcggtcgagcagcaggcgcgcgccctccagctggacggtctgggcggagagcgtgtgcgccaggatgtcgtgcagctcgcgggcgatgcgctggcgttcggccagccggtcgcgttcggcggccgactcgcgggccgcctgctcggcctccagcagctgctcggcggtgacggcgcggttgcgcgcgccgctgatcaccagggcgacgaccagcgcggcggcacagatcgcggccatcagcgggacgtcccggccggcgccgcgggccagtggcgccaggcaggtggcggccaccaccgcgccggcgaagaccaggccgggccgcagcggcagccgggccactccggcgatgatcgccacgccgcaggccagccagcccggggcgcggccgtcggcggcgagcagcgccaccccgccgacggcgaacagggcgaggccgagcagccgctggatccaccgctccgggccctgccgcaagccgtaggccgagccgcagaagctgaccgccagcgcgatcgccgcgagcacgcggtgctccggcgcggcgagcgcgacggtggcgccggccagcacgacgagcgtgatggcgcgcccggcgttcagggcccacgtccattcgggaccggcgcggtgcggagtctgcgtcacacgaacaacctacgggccggtggcaccgggcggcgtcgggcggcggttcgagatctcgtctccacccacgggtggagatcgtccacactcgaccctgcgggggacgatgaatatcgattcatgagccgacgcgcggccggtcccgatggtcctagtgtccttcggcgtagcccttcggtgcctttcgaaaggaccatgacgatgcgtcgcctgtcgccggtcttcgcactgttcttcctcagccccctggtcggggagttctttctgggagacttcgcgatcacgctgttaccgctgatcttcgtgttcgccccgatgtacggcggtgccgcggtgctgatccgcgaggtgacccgccgcaccggccgcggctggccgaccatcgtcaccctggccctcgcctacggggtgctggaggagggcctgatcacccagtccctgttcaacaaggactatctggaccagcatctgctcgaccccggctacatcccggcgatcggcaccgcgctgccctgggtggtgttcgtgctgaccctgcacaccgtatggagcatcagcgtgccgatctccctggtcgaggagagcagcacccggcgcacccggccctggctcggccggatcggactcaccgtgatcacggtgctgatgctgggcggcggcttcgccgtcttcaacgccacgcggaccgaccccagcctcagccacggtttcctggagtcgtcgccgcaggcgctgagcatcgtcgggatcgccgtcgtgctgatcgtggtcgcgttcctgctgccccgcccggccgccaccgaaccggcggcccgcccggtgcccggcaccgcgcccggcccgtgggtggtgttggccaccggcatcctggccggtctcctgttcatgagcgtgacctggtcgatcgtgcccacggtgccgggcgtcgtgctgatgctggtggccacgctcggcaccgccgtggtcgtgtcgcggtgggcacggcgggccggctggggaccgtggcaccggttcgcgatcacggcggcggcgctgttgacgtacacctggcacacgttcttcgcgcacagcgcgggtttcgtgctcgatctgatcagccacctcgtctacgcggccgcggcgctggccatcctctggtacgtggcgcggcggatccgggcgaaggcgccgctcggggagacggaccggctgcacgcggtcggctgatccggacgggggccggccggacccgcgggtgcgggcccggccggctgggtcactccccggcccggtagccggccggccggccgccttcacgccgccggccggccgcctgctgaccggccgatttcgggccgcgggccggtagcctgctgaccggccgattccggccgcgggccggttgccggctgaccggccgatctcaggccgcgggccggtagccggccgggcggctggtgaaggtgccgcggccgtgggtgcagctgagcagccgggtcgcgtacccggacagcccggccagcggcacggtcgcggtgaccgtccgctcgcccgagtcggtcacctgggcccggcgcgcggccaggtcactgagcaccgcacccagcgtgtccgcgggcgcggtcaccgtcacctcggccaccggttccagcagctccatcacgcaggcccgcagcgcctcgcgcagcgccagcttgccggccgtgcggaaggccagctcggacgagtccttcggatgcgtccggccgtcggtcagcgtgacccgcagcccggtgaccgggtggccgccgagcgggccgtcgccgagggcctcccggcagccggcctcgaccgcgcggatgtactccgccggcacccggccgccggtcaccgccgactcgaaggcgaaaccggtgtccccggccggggcgacggtcagcacgacgtgcgcgaactgaccggcgccaccgtcctgcttgacgtggcggtagaggagatcccgcacgccccgccggaccgtctcccgataggcgacctgcgggcggcccaccgtgacccgcaggccggtgcgctgccgcagcttctccagggccacctccaggtgcagttcccccaggccggacaggatggtctgggcggtctcgggatggacccggacactgagcgagggatcctcctcggccagcgcggcgagcgccggcggcaaccgctcggcgtccgcccgggtgcgcgcctcgacggccaccgacaccagcggctcggtgatccgcggcgcctccagccgcaccgggtgcgcccggctggacagggtggcgccgaccggagcgtgcttgaccccggtgaccgcgacgatgtccccggcggcggcccggtcgatctcggtgtgccggtcggcctgcacccgcaggatgcgggcgatgcgttcggtgcggccggcgcccgcgtcccacacggtgtcccccttcacgatcgtgccctggtagacgcgcagataggtgaggcggccggcccgcgcggtgtgcaccttgaagaccagcgccacggggtcggcaccggccgggacggccggcgccggaaggtagtcggtgacggcgtcgagcagcggctcgatgccccggttgcggtaggcggagccgcacagcacgacgaccgcctcgccggaccgggtcaggtcccgcagggcgtcgcgcagcgtggcgtccgacatgtcgccccactcctgcaacgcggccggatgcagcccggccacctgctcctccagctcccggcgggccggcagcgcctccggcggcatcccgtcgtgcaccgagagcaccccgtcggcccaggtcagcgtgcgccggccgaccaggtcgacgacgccgcggaaggcgccctccgcacccagcgggaactggaccagcagcggcaccacgccgaggcggacgcgcatcgactcggccaccgcggtcagcgaggcgccggcccggtccagtttgttgacgaaggcgatccgcggcacccggtagcggtcggcggtgcgccagaccgcctcggactgcggctccacgccggcgaccccgtcgaatacggcgattgcgccgtcgaggacccgcagcgcgcgctccacctcgtcggagaagtcggcgtggcccggggtgtcgatcaggttgagccggtgaccggcccagtcacagctgaccgcggccgcgaagatggtgatgccgcgatcgcgctcctgcgggtcgaagtcggtgacggtggtgccgtcgtggacctcaccgcgcttgtgcgtggcgccggtggtgaacaggatgcgctcggtcagggtggtcttgccggcgtcgacgtgggcgaggatgccgagattacggacacgcatgatggtcgaaccttcgatgtgcgaacggtcgtggacgtgcgcccatccggccgccggcgagaggacaaccaggcggtcagggacgtccagccccggtggcgcggccgggaccgggcacaccagacacgaggatcaggtcgaaacgcgacacgggggtccgcatgatggacgacccccttcgatgtgcacagcgcgacgagacgaagataggagcctcgatccccggcgtcgagcgctttatcgtggaggcgtgctgttcgagctcgctccaccgcgcggcgtgggtccggtgacgctcggcacgagcgctgcccgggtgcgcgaggcgctcacgtcgtacggcccggattgaccgtcgtcgcggtcgtcgggatcatcggcctggtccggctctggaccaggttcgggcccggctgggcgcaaccggtcaccgggccgctggccgcggccttgttgatcacggtctccggccgcaccgcacggcaggcgggactcaccgtctccggttggcggtacgcggcggcagccgtcgtgctgatcggcgtcggatacgccgtggcggtgcgactgcccgccgcgcggcggttgttccggacgacgtacgaccgcccgtggctgaccgccctgatcgaggtgccgctggccaccgtggtcttcgaggaggtcgccttccgcggggtgctgtggagcctgctcgaccgcgatcacggcgcggtcgcggcgaccgcggtgaccgccgtgctgttcgggctctggcacctcgccccggaacgcccgtggaccgacgcggtggtgaccggggtggccggtgtgctgctcggcgtgctccgggcggtcggcggcggactgctcgccccggcgctggtgcactgggcggtcgacgggatcggcgtgctcgccgcggcccacgtgacgagaaccggggttcagtggggcaggccacaggccggtgccggataaaccaggggtggccaggggtgtccgaccgctaggctcagcgccgtgacacggcgggccggccccgcaaggggggcgtaccgccgggagaagtccggacgatccgccgcgtgggcccacgcggccattggagtctgctttgacaagccgaaccgaggctgcgccggccaagctcgacgccgccgtcctcaagatcgccggggtcgtcgtcctcggtgcgatcatgtcgatcctcgacgtgaccgtggtcagcgtcgcgctgcccaccttccaacgcgagttcaacgcgacgtacgcgcaggtcgcctggaccatgaccggatacacgttggctctggccacggtcatcccgctgaccggctgggcggccgaccggttcggcaccaaacggctctacatgaccgcgctgctgctgttcaccctcggctcggtgctctgctcgaccgccgacggcatcggccagctcgtcgcctaccgcgtgctgcagggcctcggcggcggcatgctgatgccgctcggcatgacgatcctgacccgcgccgccggcccggagcggatcggccggctgatggccgtgctcggcatcccgatgctgctcggcccgatcggcggaccgatcctcggcggctggctgatcgaggccgccaactggcactggatctttctgatcaacctgccgatcggcgcgatcgccctggtctactcgtggttcgcgctggccaaggacagccccgagccgtccgagtcgttcgacttcctcggcatgctgatgctctcgcccggcctcgccgccttcctgtacggcgtctcctcgctgcccggcgagggcagcttcacggccaccagggtgtgggcgccgatgctggtcggcgggctgctggtgatcgccttcgtgatctactcgttcaagccgaagcacccgctgctcgacctgcgcctgctgcgcaaccggaacctgagcgtcgccaccatcacgctcgccgtgttcaccatcgcgttcatgggcgccggcctgctgttcccgagctacttcctgcaggtgcgcggcgaatccacgctgcacgccggtctgctgatggccccgcagggcatcggcgccatggtcaccatgccgatcgccggcatgctcgccgacaagatcccggtcggccgcacggtgccgttcgcgctgcttctgatcgcggccgggttcttcacgttcacccaggtcggcacggacacgtcgtacgtgctgctgtgcggttcgctcttcgtgatgggcctcggcatgggcggcaccatgatgccgatcatgacctccgcgctgaagacgctcaccagccacgaggtggcccgcggatccacgctgctcaacatcctgcagcagatcgccggctcggtcggcaccgcgatgatgtcggtgatcctgaccaaccagctcaacgactcggcggtggtccccgggatgaccgccccggacggctccccggtcaccgaggccggcgtcgccatcgcctcctggagcgacccgaagatcgcccaggcggttccggccgacctgctgcaccgcggtctggcgttcgttgccgactcgttcgcgacgacgttctgggtcggtttcgcgctgaccctgtcgacgctgatcccggcgttcttcctgccacgcaagcgccaggagtcgcagctcgccgcggacggtgcgccggccgccccggtcatcgtgcactgacgccgtcgccggggcggtgctgtcgccgccccggtcgtcgcgcgtcgacgctcgaccggtgaaggcgctcccgctgcggggcgccttcgctgtctctcccgccgacgacgcggtccgggcgcgtccggattcctctgccgggccccttcgggccggggtcatccccggcacgccgcgggcctcggccgcgacgaagcggtcccggcgcgtccggattcctctgcgggccccctcgggccggtcatccccggcacgccgcggggcctcggccgcgacgaagcgggcaccaccgcctgcgtcatccaataatccgaatcggtcgaagtccgtgatcaatttattggtgatctattcggccggcgtgcgggtgtcgccatttccgggcgggcagaatggccggcgacgtgtcggaaatgtgagcttagcgggctttgtgggccctcggcaagaggtgaccttggagcgctgtcagcgtttcggtgaacggattcgttgatctggtggacttgactccgtcgaacggtcgacagaacgtgcacggagcgtttcggacggttactttatgaaggtgacccgtggttggcgcgggccgtgaatcccctttgccccgcaccggaccgtcccgttggagatctttatcggatcgacttgtgaggccctcgcagaataggtcccgagtcgtctaaaaattagtgcgtcgagcgttcctgacagggtcggcgccgtgccttcgggggcggggcccatcggggagggtggtgtgatgatccgggtcgtggtggtcagagacgagggatatttcggtgtcccggtgcgcacgttcctggaacccgaaccggacatgcactacgtgaccacgctgccgatcaacggcgagctggcggcacgcgccgcgcagctgtggccggcggtgatcgtcatcgacacggagtacatggtgagtcaggtgctgccgatcgcggacgcgctgcacaccgcgatcccgtcctgcgcgatgctgctgctctgcgacccgtcgaaacggggcatgctgccgccgcggcggtggaacggcgggatgaactttctgaccaagagcgcggcgggggcggcgctggcggattcggtgcggcggctcgcggcgggggagcgggtggtgtcgccgatgctgcaggccgcctcgctgaacaccgatcgggggctgagcacccgggagctcgaggtgctggggctggcggcggagggcgagtcggtcaaggagatcgccgggcggctctatctttccgggggtacggtgcggaactacctgtccgcggtcatctccaagaccggggcgcgcaaccgcctggacgcgatccggatcgcccgcaaagagggctggctgcgatagaggtgcgcgcggaaaagcgcagcggcccgcggggcagagcgcaggggcgcggaaagcgcaggagcgtgcggaaagcgcaggagcgtgcggaaagcgcaggagcgtgcggaagagcacatcggtgggcgcggaaaagcgcatcggcgcgcggaaagctgcgggagcggtgagggtgcgcggtgggagaaggcggcgtcggggtgggtgcgcgggggcctgagggagggccggccgaggtgcggaagccgggagttcacgatgcggcaaaccggttcggctagcgtgggtttcgatgcttgttgaccgcctggagattccggcacttcccgtcctgctgccgctgggcgccgtcctgatggtgctctcctggtggtggttgcgccggcagggacggctgaccacccgacgcctggtcgtggcatgggcgctgtgctggtatgcggtggccgtcctcggcgccaccatgctgccggcccacctgtcgtgggggccgggcgccgggccgccggccacctaccgcatcctgctggtcccgacgctgagcatgcgccgccgcgacttcgtgctgaacatgatgatgacgctgccgttggccgccctgctgcacctgaacttcggcatcgtcgacagactgtgggtggtccggaccggtttcctgctgagcctgagcatcgagacgacccagctcgtgatgatcctgacggtgcacggcacccgctgggccgacgtcaacgacctgctctccaacacgatcgggacgattgtcggcttcgtggtgtggcaccgcctcatgcgggtggagcgtctccgtgccgcagtgaccggagtggccccgcagacggtgcggcccgggtgagccggtcgtagatctggcccacggtcgcggcgagatgatccgcgtcgtaccggagcccggccgtgcgtgccggcatccgggtgccgcgccgctccgccaggcagagcacctccgcgcgtaacgcccggggcagggattcccggtcgtgtggtgacagccggtaggtgccgcgcaccggcgcccgggcggctcggcgttcctccagtggcgggcacgcggcgtagaccgcgggcagcccggccgcgatggcctccagcacggacaggccccaggtgtgcgggtcggtgctggcgtagatgtccatcgcgcagagcatctcccgaggatgccgcaccgcgcccgcgaagatcacccggtcggccaccccctcgatgatcgccaactggtgcagggcgggccgggccggaccgtcgccggccagcagcagcaccgcgccgggcacctcggtgagcgcgcggatcagcaggtcgtgacgtttggccgggtgcagccggccggtcacgccgatcaccgccgtgccgccgggtacgccgaggcggcggcgggcggcggcgcgcagggccggatcgaaccggtactcgccgggatcgatggcacgcgggacgacggtgatccgccggtcgggcacgccccacccgcgcagccgtccggcgatcgacgcggtggccgcgatggtcatctcgccgaggcgttcgctgagcaggtagaacgggccgagccgggtggcgccgggccggcccaggtggtgttcggtggcgacgatgtgcggcaccccggccagccgggccgcgatccgtccctgcacgcaggcccggtacaggtgggtgtgcaccagatcgtagtgaccgcgacggatcagtgcgcgcagccggacgatcgcggccgggtcccgatcgcgggcggtacccagctgatgcaccggcaccccgctgatcaggccgccggggccgagactcaccacctcgctgtcgtgcggcagccgcggcagcagcagcctgagctgatgtgcggcgctgccctcggacgcagtgctgatcacgtgcagcaccctcatcgtcatctcccggtcgcatagtcgacagaacccttgcgacggccctgccagaacggtgccggaatggtgggtgaagcgaaagtcgcagatgtcacgtctaatgtgatgatccttcatcatcgatatgacatggtcggccgaatggccggtaaaaccgacccgaaatgtcaatccggggccgggccaggacacattcaaagaacgtgaaaaatattcgtcttgtccatgacaattgccactgtgaacctatcctcgccacctgaaaccctgaaaaccgcgaatggccggcaataggcccgaaaaggcgtcgaagtcgaatgcatgatccgcggccggttgccgccggcgacgtacgagggggaattccatgcagacacggcgagccgccgccggcgacccggccgcggatccagccccagccgcctggccctagctagctagggcgctgcccggtcaggccgcccgggccggcgccgacgcgctggccctggccaccgccctgctcatcgccaccctgctgcgccacgacggccacccggaatacctcaacggcgccggcctgatggagttgtccctggtcgcggctgtggtgcacacggtcgccgggctgtggaccgggctgtacaccgggcggtggtcgtacggctgcttcgaagagattctcgctcttgccaagaccgcggcgatcaccacgcccgcggtgttcgtgctggacacgctgctcggccggctggtcccgcggtccgcgatcatcggcgccgggctgaccgggctggtcctcgcggccggtgtccggtatgccgtccgcctgctgcacgaccagcggctgcgcccgcaccaggccggcacccgggtggtggtgatgggcgccggcgagggcgccacccaggtgatccgggccatgctgcgcagcccgtccagtccgtacgtgccggtggcgctgctcgacgacgatccggccaaacgcacccggcagatcatgggcgtcccggtggccggcaaccggcacgcgatggccgaggtggtccgcaacctgcgcgccgacaccgtggtgatcgccatcccgagcgccggcgccgagctgatccgctcgctcaccgacctggccgcgccgctggatgtggacgtcaaggtggtgccccgggtggtcgagctgttcggccgcaccgtgcgggtcgaggacatccgcccggtcagccacgccgatctgctcggccgccgcgagatcagcatcgacctggccgcggtcgccggctacctgcagggccgccgggtgctggtcaccggggccggcggctcgatcggctcggagctgtgccggcaggtcgcccagttcaacccggcgaccctggtgatgctggaccgcgacgagtccggcctgcacgcggtgcagctgtcgctggacggcaagggcatgctcgacgaccgcaacctggtggtcgccgacatccgcgaccagcagcgcctcgacgaggtgttcgccgagcacaagccgcacgtggtgttccacgccgcggcgctcaagcacctgccgctgctggagatgcacccgtccgaggcgctcaagaccaacatcctgggcacctaccagatcctgcagaccgccatccggcacaacgtggaccggctggtcaacatctccaccgacaaggccgccgacccgtgcagcgtgctcggctactccaagcggatcaccgaacggctgaccgcggcggccgacgcggccgcgcccggcacgtacaccagcgtccggttcggcaacgtgctcggcagccgcgggtcggtgctgaccgcgttcgccgcgcaggtcgaggccggcgggccgatcaccgtcaccgatcccgaggtgaaccggtacttcatgaccgtgcaggaggcggtcaagctcgtcgtgcaggccggcgcggtggccagccggggtgaggtgctggtcctcgacatgggcgagccggtgcggatcgcggacgtggccaagcggatcgcggagagtgccggcgggcacatccggatcgtctacaccggtctgcggcccggcgagaagctcgccgaggtgctgctcggaccggacgagccggatcaccggccgaaccatccgctgatctcgcaggcgccggtgccaccgctggacggggcggtgctgtcgctgctcgacccgcgctcgccgcgcgaggacctgatcgcggtgctgcgctggctggccgagagtccggcgctgcccggccgggtcgagaagccgccggcgccgcggtccggtggcagcagacgtcacgccgagttcaccatgcgcctggggcggcacccgtgagccggaccaagagagacaggagaatcccgatgcgggtggtcatcgcgggtcagggttatgtcgggctgccgctggccgtccgggcggccgaggccggccaccacgtcgtcggctacgacgtcgacgaggaccggatcaaacgcctggccgccggcgagtcgtacgtcgacgacatcacctccggacagctccagcaggtcctttccggcggcaacttccacccctcggccgacccccggacgtgcgccggcttcgacgtcgccgtgatcgccgtgccgaccccgctccgtgacggcacccccgacctgcgccacatcgaggagtcggcccgcaccctggcccgctacctgcgccccggcgccaccgtcgcgctggagtccaccacctaccccggcaccaccaccgagctggtcggcccgctgctggaggagggttccggcctgatcgccggcgaggacttccacctcggatacagcccggagcggatcgacccgggcaatcggcagtggcacctggccaccaccccgaaggtggtctccgggatcaacccggagtcgctggccagggtgcaggccttctacgcctcggtggtggagaccaccgtgccggtctccgaccccaaggtcgccgagctggccaaactcctggagaacacgttccggcacgtcaacatcgcgctggtcaacgagctcgcggtgtacgcgcacgacctcggcatcgacgtctgggaggcgatcgacgccgcgtcgtcgaagccgttcggctacatgcggttcgtgcccggccccggggtcggcgggcactgcctgccgatcgacccgtcgtacctgtcctggcgggtgcagcggaccctcggccagagtttccgtttcgtcgagctggccaacgacatcaacaaccacatgcccgattacgtcgtacgacggctcgtggtcgccatgaaccgccgccgtcgagcggtcaacgggtccaccgtgctgctgctcggcctggcctacaagaagaacagcggcgacgcccgggagtcgccggcccgccgggtcgccgcgctgctgctggagatgggcgccgaggtgctcgccgccgacccgcacgtggtcgaggacgcgcacgtcgaccagcgggtcacccgggtccgcgccacgcgagaggtgatcgccgcggccgacgccgtggtgctgctcgccgatcacgacgcgttcgacctcgacgaggtggtcgagcacgccacctacgtgctggacacccggcaccggatcaccggaaccaacgtggaatcgatctgaaacgggggaatcgtggacctcgtacgcccgatctggaatgtcctcaaccaactcgtcgccctggtcgctctccttctgctgtcgccactgatcctcgccgtcgcgctctgggtgcggatcgccgacggcaagggcgtgcttttcgtgcaggcccgggccggaaaggacggccggccgttccggatgctcaaattccggtcgatggtgcacaacagtgtcgcgatgagcgcgcaactcggcatggccgacccgttcggcctgctgcaggacgacccacggatcacccgctgcggccggatcctgcgccgcaccagcctcgacgagctgccccagctgatcaacgtgctgaccggccggatgaacctggtcggcccccggccggacgtgctgccgcaggtggccaactactcggccgaggacgcccggcgcctcgaggtgcggcccgggatcaccggatgggcgcaggtcaacggccgcgacgacatcgactggccggcccggttcgtgctggaccgctggtacatcgaccactggacgccgctgctcgacctgaagatcctcgcgcggacggtgaccgggctgcgccgcgccgagccgccggtgcacgtcgacacgctcaacatcgcccgctccgccgtggacgctacccaggagctgggccgtgccgcctgaccgggagatcggctccgaattccactgggacccgctcgccctggtcggcgaggaccgcggcggcctgcccggctgggtgccggcgcggcgggaactcttcgccaccggctgcggggcgatccgcgcggtgctgcgcgtgctggccccggccggacggttgcacgtgccgtcgtacttctgcaccggggtcgccgaggcgctcaccgaatgcctgccggtcaccttctaccggcacctgccggacgggcacgggccgcactgggagacgctgcgggtccgcggcggcgacgtggtcctcgcgcagaacctgttcgggtgggacgacaaggcgccctgggacgcctggatccgggcccaccccgggatcgcggtggtcgaggaccactcgcacgatccgttcagcgggtgggcgcgcaacagcatcgcggcgtacgtcgtggcctccctccgcaagaccctgccgctcccggacggcgggctggtgtggtcaccggccggtcgcccgctgcccgcgccggccggtgcggagagccccggcgccgcccagaaactcgccgcgatgctgctcaaggccggctggctggacgggcagccggtacccaaggaggcgttccgggcgctgcagcgacagggtgagggggcgctgctgggcagcgacgggccggccagcacggtgacccgggcggtgctgccgctgctggatgtgctggggatccgcgcggcgagcagccggaacgcgcatgcgctgcggacggcgctgcacggccgttcggccgatgagatcctgggattcgcccggggagcggcggacgtcgcgccgttccgcgtacaactcgcgctgcggtccgaaaaggatcgtgacacgctgctcgcgctgctggccgcggagcggatctacgccccggtgcactggcggcaggaccgcgcccggtggtggagcggcgaccccgaagcggccggcctcgccgaccggatgctcaccctgccggttgatcatcgttgcagctcggacgatgtctcccggatggccgaagtggtcacgtcgcaggcctcgcgcgaatcgaggagcggccatatcatcagggcgtgaggggtgcgtgcactttcggtgacggtggtcgatcgcaatgaccgccgggggctggatcgcgctgggcatcgccgtcttcggctcgctctgctacgcggccggctcgatcctgcaggccgtcggcgcccggcgcagcaccagcgcggtcaccaccctcggccacccgttgtacctcgtcggcatcggcctcgacatgaccgcgtggctcggctccatggtcgcgctccgccaactcgccgtctacctggtcgaatcggtgctggccggctcgctcgccctgaccgccttcgccgcctgggccttcctcggctccccactgcgcaaacgcgacgtcgcggcgatcggggtgacgatcggcgcgctcgccgggctggccatgtcggccggccagcagcacgtcgtcgccgcctcattcacgctgcggctgagcttcatcggcgcgctgatcgtggtcctcggtctcggcttcgcggccaccaggatcggatcgccgggcctgatcgccaccatcggcggcctctcggtcggcgccgccgccctcggcggacgcgccctgcacctgcccgacgaacagatgcgcaccgtcggctcggccgcgatggcgatcctcggcgagccgttgacgtacgtgctgctgctgttcgccgccaacggcatggtcatgtatgccaacgccctgcagagcggcgaggtcggccgggtcaccgcgatccactggacggccgaggtgatcgccccgtcggtgatcgcgctgaccctgctcggcgacacgttccggcccggctggtggccggtcgccctggccgccgcggtgatcaccgtgggctgcgcggtcgtcctggccagcgccccggcgaccgccaccctcgacgagacggccgcgctgcccgccggcgccgaaccccacgccctcccggccccgcccctcccggtgctgcccggcgcgcccggccatccggtgaccgcgctggtgccgctgcaggcgtggcggctggcgatcccgatcgaggcccgctggccggcgctgcagccgccgctggtccgcggctacggcacggtcgtatggtggggaccgtcgtgggcgccgctgccgatctgggtgccgccggatcgcaccctcgtgccccgcgaccggcccaaactcgccgaccggccgcaacggatctggcccgcccgggtgggcccgcagttgcccgagtcgcgccggccggctcggcatcgcgagatcatcatcccgggccgcgaccgcgacgccgcctgacctggggccgaagcgtcgaacgcggaacgggcgacccgggtgacttcctcgggcagatggaacagccgtacgggaagcgccacgggttcgaggcggggcccgtgtcgccgagtcgcgaggccatgtgcgcggagcaggtgtactcacggtcaatcgcgtgctgccagtcggggcgacaaggcggttggagtcagccggccatggtccaaccgaggctggcgcattccgggcagtagaagaacggcttggattggtctgcgttctgcgaggacgggagtgtgccctggacgacgctcaaccagccacgtccggtgcataggttgcacatgaccgcatccagtggctttgctggcttcaggtaagcgagctcgggatactgctcagctgctcgagcaagcgcgaagtcgcgttcggccggctcggccagccgcgcctggctgtcttcttcgtggtcgatgacgacctcaccggccggggtcaggtacatgaccgatccccagaggttgaagacggggaggcggcccgagtccgtgcaatcgctgcgccagtcagatgcttgggtcgcctcgtcgatcaatcgttcgatcaatcgagcgttcgtcatgggctcggcttcctccgtcatcgggtgggacggccaggtggaccgctcaccggtccccatcacggtatcgacgccatggtacggcgtcgaaggctggatcggctggttccgtcgcaaccagcgggtcgcggtttcttctctgaaccagcgttgatggtgaggcgagagttcagtgctgtgagcgcaggatctgttcggcgtcttccgtggacagccagtctgccgccaccatgcgcttcgcgagagtccgggcgtgctgccggccttggtcgcgcaggactgccaggagcgcctggcgatagcggtctcgccgccagccggcggggtcggcgtcgaatcgtgtcccgtgggtgagccattgctcgaacccggctcggacctcctggtcgtcgtgaagatggcccgcacgcccgtcgacggtcagggcgaagccgtgcagttgctgcagacccatcatggtgatcggatcctcgacggcatcgggcgggtcttcgacccacggacggacgcggtcgaacgtttcctctcggctgcaccggccgtcgagcagatcacgccaccaggcctcgacgtcctggcgggaaggtgctgtcaccggacggtgagccgacccgtcctgcgggtcccagagcgtcagttcgtactcggtcgccaactccgcgatcagcgtggtcgcagggtggctgcgttcactgaagctcaggcacatgaacacgtgatcgatgccgacgtccagtggcatcgacatccacgggcagtcatccgggtccgggtacggcggatggtcggggaatcgtgcgcgcagccgctcatagaagccgacgatccgttcgtcgagttccccttcgacatggccgggggcttggcaccgatgggccattgcggcgacctcggaaacgtcggtccacccgtcgatcgccagaacggcaaggtcaaaactcaaccggatcgtcccctcccgcggtcagcatgatcaacggatcccaccctacgattccgcggtgccggtggcggtcgaagtcgccgcccatccctcggccggcccgggctcgcggggacagtgaccgtgcgtgccgcgcgatccggggaacggccggcatgccgattgccgcggcgtggcgttgaacggtgttgtctgggccggcttctctttgggcgcaacgagttcccgggggcgccggaccgcacgatcgagccccgcggccggcgggaacccgccgggcgaccgcgacggatccggccgcccggtaccacgggatgaccatcccgggccgcgaccgggacgccgcctgacccttgtggtgctctactccggcagccaggccgtggcgcacacctcgatccaggtggcgagatccggcacgccgtcgatggtgagcagtccgtcggcgatcgcggtgaccccgtcgaaggcgtggtccggcgcgaagagcagcagccggccgtcggtccgccgggccagcgtcaggttgccgttggcctcgaccgcgaccggatagtggtcccgcggctcaaggggcgtggcaccctcccagatccacgcgtaggcgtcgaacggcccctccaccggctccgcggcggcctgcgcggtgagcacctcgttctggttctcccaccaggacgagggctcgccgaaccgctcgacgaggccgccgcagaccgcccagaagtcccggtggacgcgcggcaccgtgaggtccgcctcggcgcgcgggggccggcacagccagccgcgccgctcggcgggcgggccccaggccagcaactcgaagtggtcgtcgtccacggtgaccggcgtgcgggtcgccgtcgccagcaacgcggacaggacgggcaggccgtcgaccggctcgcggtcccagggctgcggatcgcccacggtcgcggtctgcccatcgtcgaggaaccacgagatctcgtggcggaaccggtcccagtcggtcatcgattcatgatcccatcggcttgtgacacgatcccggcatggcggagatcctcaccaaggtcggtaaggccgacccttccctcaaccgggtgctcagcgacgaactggacaggttcaatgcggccgcgacgccggaggtcgctccggccgaggaactcacggtccgggtcgagcaggagggcgagctggtcgccggggtctccgggtggacctggggccaggcggccggcatcgggatgacctgggtgcgcgaggatcaccggggcaccggggtcgggacgggggcgatgaccgccttcgagagcgaggcgcgaagccgggggtgcacgcacgtgttcgtcacgtccttcacctttcaggcgccggccttctaccagcggctcggctaccgggagatcttccgctgggagtcggtcccgacgaccggccgggacgacgtccacctgcgcaaggaactctgacgagcggcaggctggtcctcgttgtccggtgggccagggtggccagggcggtgagcaggatggccggggccagcatggccagtgggttcatcacgtggatgcggacgacgccggccgcgtccgccccgttcgtgaggtagcgcagccagacggccagggcgaccgggagggtggccggcggcgccggggccagggccgtggccaggttgccgcggaacgggacgacggccaggacggcggcgccggcagcggcggccgaccagagatcccgggtggcggactgcagcgcgtcgttgccgccgggcacgagcagccggcggacgagcagggtgatgacgaccacggcgccgatggccgcagccccgatcgacgcagccccgatcgacgcagccccgatcgacgcagccccgatcgccgcagccccgatcgccgcagccccgatcgcgcaccgccggtcagatgcgacggtccggatggggctggccgagcgagcgcaggtcgaggcggccgtccagggtgccgaccgccagggtgagcaccccgtgccggcgcagcacggtggctgagcggccgggcaccgcctcgcccaccggcaggccggtctccgcgtcccagcgccgcaccacctcgtcgtgccccgcggtgatcagctcggtgcgcccgttgaccacggtcgcggtcagcgtggtcaccgcggtgctgtcgaccaccaccggcacgcccaccggttcgccggtgaccgcgtcccagcggtgcaggtcggcggtggcggcggcgatcagcagccggccgtccggcagcggggccggggccagcgccagcaccgcctcgtcgccgacggtcagcgcgggcgcggtccgggcgccggtgcgcgggttccagcgctggatcgtgccggtgcggtcgccggtgcagacgaccgggccgtgcaggacggtgaccgcggtgatcggctcctggtggctgccgagcggctccagccgggcgccggtgccggcatcccagcgcagcagcgtgcccggcgcgtgcccggcggcggccagcagcgtgccggcccacgcggacatcgccgcgattccgccctcctcgtgccggacggtcccggtgcgcgcctcgacccagtacagcccgctgtccgcgccgaccgcgatcaccgggtcccgccagccggtcgggcacgccacgatcgcggtgatcccaccgatcgccgcctcgctgaccggccggccggtgcgcgggtcggtgacccggaccgtgccggtgtccgcggagaccagcatgtcggtgccgtccagcgtcagcgtcgtcaacagccgcgcatcggtgatcatgacccggatgatgccatcgaacgggcacaatgcgttttccgacgcgccccgacatgacccagggctcatttccggccacggcattagggcatccggggcgggtccacccacccgcccgtttcccggcggtgcgcgccgccgggaaacgggccggcatcacccatcgacggcgacggtcagcggggagacgtagccccgcggtcaccgagccggtcacggtgcccatctcccgggcggccagatcgtcccggatcaccatgtcggtggccaggctgatccggctggagatcggtgacgctcgcggaacagccggtagcgccggcgtagaccgcctgcgacacgtcctcgggcagcgcgatctgcgacgtcttgcggatcggcccgacgccctagctagctaggccaccgccacgacggtgccgccgtccgccggacccgccgcctcgcctcgcgccctccgccggccgagggtgcgtcgcgcgccggacggtcgatgacccaggcgggtcacgtcatgtcgatggaccaggcgtcgtcgcgtacctccggctcggggtgggcacgcagcgacagcagcaggtcccgccagcggccggcccagctgaacgagtccccggcccggaccagggcgaccgcgaacaggccgccgggcaggtcgccgcgggccgccagggtggcgatcaggtcctgcaggaccgggactgccggccactccgggagttcgcggagcctggcgccgacccgctcggcgatgcgtgcggcgagcaccggccggtcggcgcagcggtcggcgatctccgccaggttgtccagccggcccagcgtgaccagggtggcgacggcggcggccagatggccgggatgctcggcgagagcgcggaccggctcccgcagaccggtccggtcggcgtcggccgggagggcgcgggcgagtgcgcccacggtgcgcagcagtgcgccgatccggcggcgggccggatggtcaccaccgggggcaccgggaccggtctccgcgtcctcccgggtgaccagggtggacagggcccgggccagcgcctccggcccggcggcccgcagcaggccgggcgtcacggcgtccccggtggcgacgaccaggtcggtgagacgttcgacgatcaggtcggtggccgccggcgcccagcgcgaccagcccggcaaccgggcgaaagcctcgcgccggatctcgggatcgtcggcgcggcaggcggccacgaccagggccgcgtaccgcgggcggtgccgggccgcgatcaggtacgggtcggcggccaggaccgcccgacgctcctcccggggccggcccgccgcgacggccagatcgaggacggtccagctcggttcggtgtccaggcgctgacgggcggctccgatgatcgccgcgcggatgtcgcgatgggtcgccggatcctggaagacggcgagcagccggcccaccgagtccggcggcccgtagcgggccaggatccgcaccgcctccttgcggctggtcaccttcgccaccgccgaggtgctcagcagggcctcgagcggtggcgccaggacggcgggcggcaggtgcttcgccgcccgggcggcggcgtagagagcgacccgggcgcggtcgtccgcggcgtgccggagcagcaccggcagggccagatcgggccgggccgaccagaccagcgcaccgagcgcggcctcggccagcggaacctcgggcgcgtccacatggcgcaggaccaggtcgcggccgggatcgccggccggagccgcgatgtgcagcgcggcgatccgggaccagaccgggccgcccggatcggccacgatcgccgcctgcaggtcgacgaacgccgcgtgctggcgcggcagccaccggtccgggcgggccggcccgcccggcgcccagtggccgcggctgttggcgaagcggccggtcggacggcgggccagtacccggtccagcaggtcggtgcgggtgccggcgacgatccgccagaccgggccgagcagcaccgccgacggatccgcggcgagcacctcggcgacccgcgcggcacggtgccgcgggtcgtcgagccagcgggcgatggccgtctccgcgatccgggccgtggtgcccgggatcgtgtcgcgcagcatccgctgcagctccggcaggtgatgggcgcggcggccgagcgcgtcggtgagcgcgaacaggggggcgtagcggccccgggcgatggcggcctcgacccacgggcggagccggtcgaagaccatggtctcctggccgcggcgcagcacccggtcgaaacggcgcagcaccggcaccgtggccgcggtgctgaccaggtcgatcgcgagcagcgaccagtcgcgcagggccggcacatcgacatgatgctgcagggttccggtggccagccggctcagggccgtggtggtggccgccgacgcgtcccgcgcctcgacggcgtcggtggtgatcgtggtgaggtcggccgcggacccggcggtgagcagcccggccacctgggcgagttcggtcagcgcggtggcccggaccgggtcctgttcgttgcgcatccgggtcaggcgggcgaccaccgccgccaccgcctcggggtcgcgggcgcggctggccgcggcgatcaggcgggtgtaaccccgggcgcgctcggtggcgtccccggagcgcagcgccgcctcctgcgccgtggccgcctgcggccaggccagatacgcgctccagtgcaggaccagggattcctgttcgcggatccggtccaggccgaggacccgggtggcctcgcggatccggacggtggcgggcagcgcctccatcacctcgtcggccgggatcagcgtcgtggtgtcgacctcggcgagcgccgcgtcgtagagcgcgccccggcgggccggcgcaaaggctcgcagcagggcggcgaagccgggggcggactcccggacgtgccggaacagggggatcacgtcatcgtcggggagggtggcgaggcggcgcagcagcttcggcgacagcctgcggtgccgcagccatccggcccgtgccggagcggccaggagacgggccacccgcccggggtcgtgggcggcgagaacgccgtacccggtgaggcggccgggcagctcggtctccggcgcgcatcgctccagcaggtcgagagcctgcgccggggcgagcgcgagcaccgcgccggacgaccgtgcccactcgtgacgccgatgctccggcgggaccgcggccagcgtcgcggtgaggtgctcggcgagcgcaccgggatggcggcggttcaggctctccagccggacggcgtgcgccagctgggggagcagcgcccgcacggtctccgggccgcaggccaccagcagcgcaccggcctcatcgtcgccgaagtggtcgcgcaccgtgccgatcagccggtcggcgagcgccggcaccggatcgcggcgcagcacccggtagacgtgccggcggtcggcggccgcgaggccggtgatcgggagggggagacggccggcgcgggccgcggcgcccagcgcgagcttccgcagcgcgggcaccgggtcggccgccgccgcgtcgatgcccgcggtgtcgccccgggctagctagctaggcccgcggtgtcgccccgggccaggtccgcgatcagggcgaggcggcgctcgtggtcggtcccggcgcgcagcgcggcgcagacttccggggcccggggggaggtgcgggcccattgcgccagatgccgcatccgcgcgtggtgagggagcgggtcgagggtggccaggaggctccgcacggcgcgggcggtgaacggcatgacgctcattgtggcgggccgtcgacgtaccgccgaccggttttgatccgtgccctcgtcgagaccgggcagatcctcgggggtaccgatgttcatcgatctttgttggcgtgggacccgttctggtgggtgtcgccgcggccgcggtgctgcgacgctgaccggcggaccacggtcgtgctcacctgcgggtgatcgtgatgcggtcgccgatccgcagtgggccgtgacgctggaccgcgccgtaggcgccgacgcaggtcagttcgccgaggtcgaagaccgggacccggttgagccgggcggcggtgcggagcacatccgggtcgtcgggcaggtcggctccctgggcgagggtgggcaccgcgcagcgcggggtgggtgtgacgatgcggatctcggcgtggcccgcgacggtgatggtccggtcctgccaggtgttctccgcgaagggtgcggcgtcgtccaggtgcaccacgaggttcgggcggaaccgtcgcgggtccatgcggccgccggggtgccgccgggccagggcgtcgagggtggcggtggtgatcacgtggacggcagcgtagtcgacgaaggtgttgccgggggtgccggccgccaggctgctgtgggtcatcgtgccggcgccgggctctgtcggcggggtcagccgctccatgctcgcgtcctgcgggagggtggcggtcagtcgcacggggcggcccaggacccgcgacagtgcgcggtcggcggtgggtgcgtcggtgtggatctgttcgccgtcggggcaggtgatgaccacccggccggccggctcgtgccgggcggccatcgagagcagggcgcgccaccggcgagggttcttcgcgctggcgaccaggccggtctcctcgtcgagcacggcatgtcggcggtcgccctcgaagcccgaggcgtccaggtgggcttcggtgaggtcctcgccgcacatcgacttgaccgggtaccggccgagccacaccacttcccccatgactccccctgtgtccgcgccgcccaagatatccgatttcgaagatcgggaatgggcggggccgctcctagccgaccgcggacggctgctgcatgaccacccgattgcggccgttgcgtttggcctcgtacatggcggcgtcggcgtcacggaccagttggccgaagccctgggtgcccgggcggcaggaggccacgccgatgctggcgccgatcgtcgtcgtctccgggccgacgtcgaacggggtggccaccgccgccagcaggcgggcggcgagcggctgcggatcggtggtggtcagcaccgcgaattcgtcgccgccgaggcgggccaccacgtcgtgcgggccggcggcggtcagcaggcgttcggcgacttcggcgaggacccggtcgccgcgcgggtggccgtaggtgtcgttgatcggtttgaagccgtccaggtcgatgagcaggatggcgacccggccgggggcgccgggcagcagcgcctgttcggtgcactcctcgaagcggacccggttggccaggccggtcagcgcgtcgtgttcggcgcggtaacgcaggtcgtcgacgagggcggacagttggcgggtgaggcggcggttgtcactgatgatcagcatctggcggaggacgacgagggcggtcagggccatgctgagggtggccaggacccggtcgaggtggccgccggtggccaggatggtgacgccggtgccgaaggcgagcaggaacgggacgtacgggagataggcgcggggccgtccaccgtcgccgatccgggtgaccccgtgcagctcgtcgcggtgcggggcgccgaccgcgaaggcgacccaggccagtagccagagcaggtcgggcaggctgccgaaacggtaggtgccggcgatggtctggtaggtgtacacactgtccgcggtgaactggacgatcatgccgagggcggcgatctccagcgggacccgcagcgtggcgctgctctcggcgagcagcagcaggaccaggctgatgatcaccacgtcagcggtggcgtaggcgaccgtgccgaccccggccgcgccggatcgatgctgcggccccagcgtgagcgcccacaccacgaagaacagcgacatgccgatcatcagcgcgtcgaacagggtgcggatgctggccgacgggcggccgaccagcagcaccgcggcggccggtgcggccacgatggtggcgctgaagccgaggttggcggcgaccccgatggcggcggtgccggtccgccagccgtcggcgagccagaacagttcgccgatcgcccagccggccccggccacactccaggtgatcagcccggcccggatccggccgcgggaccgtgccgcggcgcgggcccagagcaccgacaccagggccccgatgccggccagggtggactggctgatccggccggcgaccaccggcgggatcggcagcacccggaccagcagcacgtacagggcgacgaacaggatggccgccaagcccgctgtccgtcgcttccgcaccatgtccgcaaccatcggaccggcggtcgccgaccttagggttaggtgagctgcagcgggcggcgccgggcccggttccaccgccgggcggacagcgtccagcgcagcatggtgcgcgggagtgcgccctgggtcgccatgtgcaacaggtatcgccaggccgggtactcgccgcgccggttggacagggcgtaggagaaccgtttcgccggcagcccggcgtagtccggcatccgctcgaaccatccgctgctggcgtgcgcggcccgctgcagcggggccagcgcggtcttgcgccgatgctcgtactgctccagcgcggccggcagaccctgcggcgcggtgtccagggcgtcggcgagcgccatcgcgtcctgcatcgccagtttcgtgccggagccgatggcgaagtgggtggtgtgcgcggcgtcgcccatcagcaccacgttgccgtggtcccagcgccgggtggtgacccgccggaagttcagccagccgcggccggcgtcgtcgagcggctgcccgtcgagatgcccggcgaagatctcttccaggcgggtgttgccggccgccgggtccatccggtcgaagccgaggccggcccacgtctccggggtgcattcgacgatgaaggtgctggccccgtcggcgaacgggtaggcgtggtaccagatccagccggcctcggtctcctcgaagccgaaggtgaaggtgcggaacacgtgcggggtgccgagccagatgtaccggttgcggccggtttccacctcggcgccgaaatgctccggatcgcggtcgcggatccggctgccggcgccgtcgcacgcgacgatcaggtccgccggcggcagcatggcgacatcggtcagctcatccttgtagtgcacgtcgacgccgagctcggcggcccgctcaccgaggatctccagcagccggtgccggcccaggctgaaaccgtatccgcccaggtgggtgacgggtttcccggcggcacggacctcgtactcgtcccacttgtaggcggcgtcccagatccgggcggcgctgatcgcgtcgtaccggaagagatcgtcgagaaggtcgtcccagaagacgacgccccagccgtaggtgacgccgggcgggttgcgctccagcacggtgatctcgcggctcgggtcggcgagtttcgccagcaccgcgaagtacagaccggcggggccgccgccgacgcaggtgatccgcatgccgcgctcctagcggtaagaggggaaggtgccggtcaggtccgcggggtcggcgccgggccgcttccgaaggaccagtcggtggtacgccgtagggtcggtgaccacgcgccaggtgtggaacgggtggcggctgggtgagaaccccgccttgtacgagaacagcgagtcctccccgccgcctttgcccccgcccaggtggaagatccgtgcgccgcgctcggagcaccaccgccgcaccgagtcgtacagcagctcgtcggcgtaccgtccccgcgcgcggcgggtggaggacacgtatccggtggcgatcccgtcgtactcgaagaaggtgttgccccccaccacctcgtcaccctccagcgcgacggcgaggtgcatccggtcgccgaccgcgtcgtgcagggcggcgaggtgctcgtacgtgaagaagtagtagtcggccgcgccgacccggcgcatgttgtcgtggtagacctcgacccagtcggcgagccggctccagtcgtcgaagacgatccgggtgccggcgcgtttcgcccggttgatgtggttgcggtggtcgctgcgggtctgccgccacatctcctcgacgctgaccgtcaggtccatcgacaccgtctcgccgtgccggaccagcgcgccggcctcgccgagcaccggcgacggcgggtcgagcagcgggtgcatccggacgaacagcgagacgatgccggcctcgcgcagcgtctcggacagcgccgcgcaggcggcccgccagaactcggtctcgtgcggcgcggcatcgctgaccgggccgggatagccgtacggcgagagcgcgtcgcgccggtccgcatccgggatgtcgcgcaggatcagcgggatcagcagccgtcgggcgccgcgttcgaagtggaacgcggccggcgtgccgccgtacagccgggcgtccagcacgacgtagtcgggaacgtggtacatgtcgtgccggacctgctgcaacgtctccttccactcccgggccgccggatccagcagcgatgccgtcatagatgtctcctcacgcgcgcaggatcttcgcattcagcgccatgttcgcggcgaactggtcgttgaccacgccgtacgactccaggcggtgctggacgtccgcgtcgtagcggccgagtttgacgaagccgtcggcgatccagccgttgtccatccccgtgccgtccacgtatccgtggtacgtggtgccgcccggccagatcaccttggtgagcaggttgccgaacgcggtcatgtcggccgcgttccaggtggtgccctggtcacgggcctccaccacgtacgccatcaccccgttgccgtgccccacgtcctgcccgggccggcgggtggagccccacacgtcgttccagaagtacgcggtcggctcgaccgggttgcggatcatctggttgcggatccgcccgccgatcgtggtgtacacctgccgataccgggtggcacgggcggtgtccccggtgagccggcccaggttcagcgcgatcagcgcccagtgcgcggccatgtgggtgcggtcgcggtagatggtgtcggcggcgccccggttgtaccacttctcgaacacgtccacctcggcgaacgagagcagccgagcgtgccgggcgcggtagccggggtcgccccacaccgcggcactctgccgcatcgcggtcagcaactgggtgccgtaccgccagaagtagctctcgtagagcggcacctcgtcgccgtcctgcccggacttgctcgacgcccagccgcggtaccggtcccggaacgtgctgcgcgtcagcgacgtggacggggccgccgaggcgaccacgttctcgacgtaggccagcgcccgatccaggtagcgggtggcgccggtggcccggaacatcgcgacgttgccgtccagcgtgtacgccaggtcgtagtgatcctggctgtcccgggaaaggctcagcggctgggcggtcgccgactcgtagtcccaactctgctggaagaccgcggcccagtggctgaccggtttcagggcgcgcctcgcggcgggcgccgcggccggcggctgggcggtgatcggcatggcgttgcacggccgggcggagctctcggccaccgtggcggcgaccgcgatgccggcaccggccagcaacagggtgcgccggggaatcctattcacgtacctaccgcctctttcacacgggcgggctcggcggacgggaccgtccgggcccgcgacaccgcggccgcggcggccatcgcggcgaacgtccaggccagccgggcgtcgtagtaatccccggagaaaaggctgctcagcgccacgaaaacggccgccgccacggcgagcccggtggcacggggaagggctccgccgccgcgtacggtcctcgtccacagtatgagcgcgccggtgagcaggccgaggccgatcagcccgccctcggcggcgaccgccagcacgtagttgtgcggatactccaccatctgattgacgccgatcaggccgtagaagccgtccaacccggcaccggccagcggatggtcggtgaacatccggatcgcggccgcccagatgtcggtccggtcggacagatactgctcctggaccgtctgctggacgaaccgttcctggaacaggctggtgaactcgggcggcgcggcgaaccagatgaccaggccggcggtgagcaggaaggcgccgcaggccaggaccgggccggccctgagccggccgcggatcttcgcgagcgcgaccaggccgaccgcgccgccggccatcagcccggcgcgggagccggagagcaccgcggccagcaggaacagcggcgtgaccaggagcgggagcagccggcgggtggacaggaacatggcgatcgcgctgatcaccccgaggatctcgatgcggacgaagacgttcgggccgccgccgaacgcggagtagcggccctgctcgccggggccgttgatgaagatcgcggcgagggcgaagacgatcgcggcgagccagaacagctggaaggtgaacaggatggcacgctccgggtcgcccagcgtccagtaatagaaggccaggatgaggacggcgagcaggatcaggtcgacggtctgcgggccgatgcgcgcggccggtggggaccagagcgccgaggcgatctggaacaggaggaagatcgaggccgcgaccagccagccttcccggccgacgcgcggttgcggccggcgccgggcaagatcgatgaggagtacgacgagggccaccgccacgccgatgacccgcaggtcgacccacgccagatcggggaagccggcccggtccagggtgaagcggccgccgatgccgatcagcacgagcagcaggccgggggccaggaagatccgcctcatcggcggtcccgcacggcgtaggtgctgagcagggcgaagagcaggcaggcgccgtacccggccagcgagccgtaggccgccccgaggatgccccgccgcgggatcagcagcaggtacaccgcgaagctgacgacgaacccgacgatctcggcgaccgacaccagcttgctgtgccccttggcgatcagcagcccgaggctgacccgggacaccgcgtacaggccggcggcgaccaccagcggcagcaccacgtcccgggccgccgcgtactggtgcccgaacaccgggacgatcagcaggtacagcgcgccggccacgaacgggaccaccaccagtgaatacaccgcgacggccagcacgatcggccggggccgcagcgagccgtcccggtgcgcggcgcgccagtggcccagccgggaatcggcgtacgcccggatcggccaggccagcagctcggtcatggtcgcgacactggtgtagaggccgagtgccgcggtcgacgccagcgccgggatgaccagacggtccacccgcagcatcgccatgttcgagatggccgccgggaacagcgccaggccctcccggcggacctgacggttcaggtcgcgacgggccggggcggcgtccgggtcgggcggcaggcgcagccagatgatcaggtaggccagggtgggtgcggcgccggcgaagacgtacgccaggaaccagatctccgggtgcgaggtgtggtggacgtagagcccgatcagcatcgccagcagcagcaccgactcgagcacccggcagatcatgaaatcccggacccggccgaccgcgatcgccaccgaccggctggccagcgccgacgcctccacgacggtgtacaccgcgagcagcgtgacgatcatcgggccggggctgcggtggtgcgccgccgtggcggtgaagagcaccgccacggccaggccgatcgccgacggcaggagcaacagtttcgcgtacgcgcggaccgccggccccggtgccacattgtgatagccggcgacgaagctgcgctcggtgcccagcagcaccacctgggtggccagatagaccacctgcagcatcagcgcgacctcgccccggtgggtcggggtcatcgagcggaccatcaggatgttcgcggccagcgccacggcaccggtcagcacctgggacgccagcagctggacggcgggctcgcggactatcgctttttgccgggtgacgtcggcggcgagctcactcaccgtccgtcggctcctctggctccgacgtctcgccggccagcgccgccttcaccacccgggcgcggccgcggaccacgcctttcgcgatggccggctccggttcctccagcgggatcagctcgtcggccggggccacccgggccgccgtcgcccagtgctcaccggtcggcagcttgcgcggcagggcgttgagtaccgctccggccagcttcgcgccgatccgggtgagcaactccaccgacttctccacgtcggcggtgcgggtacggccggcccggaccaccagcagcgcgctgtcggtcacccggccgagcaccgcggcgtcggccggcccgttcagcggcggcgcgtcgagcagcaccacgtcgaactgctcggtcagggagcgcacggtggccggcagccggggcgaggcgagcaggccacccgggtcgggcacctgctccccggccggcagcacggtgagccgcccgttcagcgactcgtgcagcacgtccggcacccgggccgagccggccagcacctcggccagccccggcgccgggtcgagcgacagataacggccgattccgggcgtgcgcaggttggcgtcgaccaggacgacccgggccccggtctcggccagcgcgatcgccagcccgcaggagaccgctgtggtgccctccttgcggcccggcccggccagcaacagtgcccggccgcgcgggttgccgcgggcgccgtcggtgatccccggcagcacgctgcgcagccgccggaacgcctcggcgagcgtctggtccggatgatcgccgcgcccgtgccgcccgtccagcgagatcacccccaccgtgcccaggccgagccggcgcaggtcgtcctcctcggccacggtccggccggcggcctcccggatcgccaccgcgatcgccccgagcagcaggccgagcaccgcggcgaagccggtgttgcgggccaggttgccgggctgacgggtggtttcggcgtcctgcaggatggagatggccgcggccggtgtgccgtccgggttcgccggggtgatctgcttggccagggtgaccagcacggtcgcggcggtggtgacgatctcccggctccgcgccgcggacgggtcgacggccgcgatctccagcaggtcggtgccctcgctgacctgcgcggacaggctctgccgcacctcgtcggcggtgatctgcccggagcccagccgggcgaccacgccctgggccacccgggggccggtgagcagggcgatgtacgagttgagccggcgcgcctcggcgtccgggtcaccgccgccggccgaggcgaacaggatcatcgacgaccggtaggcggccggcgcgctcaacgccagaccggccgcgatgccggcggacagcaggaccgggatcagcagccagagccaccggcggcggcaggcgcgggcgtacgcacgcagttccatggatcccccgttcctctaggactgcccggacagcacggcccggccggccgccgcgcggcgcgtggaccgctccagcaccgcctcgaaacggtcgaagagcagatcccgggagaaccgctcgacggccagccgatgcgcggcggagcgggcccgatccagccagtcctcatcgcgtacccgggaagccatcagatctccggcggcggccggattgccggggtcgagcaccagcccggcgccggtgtcccggagcaggtcggcctgccagccgccgtagttgatggcgatcggccgaccggccgcgagcgcgtcgaagaacttgttggccgagttgtcccacagcccgcggatcggccggaccatgctggtcgacatggtcgcggcgcccaggatcaccggcagctccgacttcggcaccttctcccacatccggacgttgcggtcgagcagcccgaggtcggcggcgagccgtccggtgctctcccactcccggccgtgcccgacgatcagcacctggatgtccggatcccgttcacacatccgggcggtcgcccggaccaggtagtcgaccccgttgaccgcgcccagcgcaccggtgtagacgatcagcggccggtccccgagccagcggtggtcctcccggaaccggcgcaccgcggccgggtccaccgcgaacaggtccatgtcggcggcgttgggcaccacggtgaccggggcgctgggccggcgccggttcacccccatcgccatcccgggggacagggcgatcacctcggacgcgttgcggtacgcgaagttcgccagcgccccggccagcccgcgggccaccgggttgcgcagcgcgcccatctcgatcggcacctccggccacaggtcacggacctcgaagacgaacggcacccggcgcagccgagcggcgagtacgccgggtaccgcgacggtgagcggcgtgctggtcgcgaagaccaggtccgcgctgagccgggtggcccgcgccgtggcgaggaccatgaactcggcgaaagcgcgcagccgccgcgcgtacgacatgtggttgttgtaggggacccggaaccagtgcacggtcaccccgtcgtcgtgggtgaccttccagccgagcccacgctcgcccggggtgatgtcggtggtgatcacgtcgaccgtgtgcccccgggccaccagccgtctcgcctgctcgtaggagcggatgcccccggccatccgggggttgcagtaatactggtggatgtagacgacgcgcatccgccgtcatcccttctgctcggcggcaaccgagcggacggcggccacgacacgttcccggtcgtgcccggagagggcggaaccgctgggcaggcacagcccgcggtggaaaagatcggcgctgacctcgccaccgcgcatcacacagtcgcggtagaccggctgcaggtgcatcggcttccaggtgggccgtgcctcgatgtgctgcgcggcgagcgcggcgacgatccggtcgcgcagcccggtggtcgccaccagcaggcagctcagccaccagttcggcacgccgtagccggcgaccggctggaagctcaccccgggcaggtcgccgagggcggcccgatagtgctcgaaggtgacccggcgagcctcgatcatcgccggcagccgctgcagctgaccccggccgaccgcggccagcaggttgctgagccggtagttgtagccgaccacccggtgctcgtagtgcgccaccggctcccgggcctgggtggacaggtgccgggcctgccgggccaccgaaccgtcgtcggtgaccagcaccccgccgccgccggtggtgacgatcttgttgccgttgaaggacagcaccccggccagcccgaacgacccggccgggcggccccggtaggtcgcgcccagcgcctcggcggcatcctcgatcagcggcaccccgtaccggtcgcaggcctccaggatcggccggtagtcggcgcactgcccgtacatgtcgacggcgatcaccgcgcggggcagctgaccgcggaccgaccggccgcgcaactcgtcggcgaggatctgcgggtcgacgttccagctctcccgggtgctgtccaggaagaccgggcgggcgccgagatacatcaccgcgttggcggtggccgcgaacgtgaacgacgggatcaggacggtgtcgccacggcgtaccccggccgcgatcaacgccagatgcagggccgcggtgccgctgctgagcgccaccgcgtgccggacgccgaccagctccgcgcacttctgctcgaacgcgtccagatccgggccgaccggggccacccagttcgagtcgaacgcgtccagcaacagtttgcgctcgacgtcggtgacgtccggcgggctgaggtagatccgcggctcagtcatggacccgggtccgcaccgccatgatcggccaggccggatgcagcccctgccggtggatccacatcggggagtcgccggtgtgcatggccggccgccgggtgctggcgaaactgcggtagcccgcctcccgggccacccgcacgtcgcgctcggtgtagtcgaccgccggattgccgtacggcgcggcgaagtccagcaccggtacgcccaactcgtcctccatctcccgcttcgagtcggcgatctcccggcgcgcctcccgctcgtcctggtcggccagccggtggtgggtcagggtgtgcgaaccgaagccgaatccggcctgccggatctcccggcagtccgcccaggacaggttcccgggctggccgaccagcccggtggtgaggaagaacatggccggcacggacagctcccggagcaccgggacgaccacgtcccgccagctcaggtgaccgtcgtcgaaggacaggcagaacatcggaccggtcagcgggcggtcgccggccagcaccgcgagcgcctcctcccagccgaccatcgggccgagccggcgcagggtgcgcaggtggtggcggagatcgtcggcgtactcgggcagcacgtcgtggtagaaggggaagtagaggccgggggcgctgggcaggcggcggaacagtccggccggggcgagcacccggccctgtgcccgcggccgcgcccggaggcggctgcgtatgcccaactcgttgagacgtcgcttgatcgccgtcggcggctccatgcctttaccctggcaaatggacgagcgggcgcggcagtagcaattgtcacgccgaacgcgaggatcactcacgtcaattctcgaatggtcgtacgggcccttgcggaatggccgtccggccgggcatcatccgccttcgacgcctaattcgatcggggcgagtgatgcttcgtctgcagcgggtcgagccggctccggccgtccacgccgaccgtgcgacctacccggaccgccttctcttccacacacccgagtggctcgccttcgtcgccgaatgccagggcgccgagccggtgcttgccaccgtcagcgatggtggggtgacggtgggtcacttcaccgggcttctcgtccgccgctacggtctccgcatcctgggcagcccgatggccggctggaccacgtcctacctgggtttcaacctcaaacccggagtgtcgcgccgggacgcgctgggcgcgctgacccgattcgccttcgacgacctcggctgcgcccacctcgaagtccgtgaccggggcgccaccgaggccgatctggccggcaccagcctgcgctgggacgccgcgcccaccgcggtgatcgacctgcggccgggcgaggacgccctcttcggcgcgatggccagcgcctgccggcgcaatatccgcaaagccgccaagtccggggtgaccgtcgaggaagcggacgccgacccggcattcgccgacgaattctacgaccaattgcgggacgttttcgcgaaacagaatctggttcccacctattccgtggaacgggtcaagtcgttgatccgacacctcgccccggccggccggatcagcctgctgcgcgcccgtgacccggccggccggtgcgtcgcgacggcggtcctgccgtgggcgcaccggaccatgtacttctggggtggggccagctatcgggaacaccagcacctgcggcccaacgaggcgctgatctggtacgcgctgcggtgggccaaggcgcgcggggtgaccgaattcgacttcgtgggaggcaacccgtacaaggccaagtacgggaccaccgaggtggcggtgccctgggcacgtcagtcgcggtcgccgctggtggccacactgcgggacaccgccaagcaggcgtacgcctggaaacagcgaaccgccgcgcggctgacccacctgccccgctaggagaccgcgaccagccggcggtcggttcgattgccggtgatcagcttccggtcgtcaggagcttcccggacggtccgtggctggttcgtcggtcacggggcgctgatggtgcgcctccggggtccggtgccgctggctgcgcccgccgtcggccggatcctcggcgatgatcggcggcggcggggtgatcggaccggtcgggcgcagcggcttcccggtcgtcggcggccggtagggcggcaggttcggcagcgtcgagctcaccgttgcgctgggcggtccatccgccggggtcccgaccgcggtggcggaagacatccgcaccgggggcgtcgaggacgtcaccgactcgaccgtcggggacgcccaatcacccaccgtgaccgtcacggtcggactccgcgtcaccggggacttcgatccgctgcttcccgtgtcaccgcagccggcggccagcccggcgaccgccaccagtgcgatcacagcgaagtcgacacgcttgcgcattaccggccctccggcccccagcagcaatccggcggccagtgtcgcacgctcccaccgttccggcgattcccgtttcgggtcgactttcccgactcgtcacgcccctctcggcccgtcatgcccttcccggcccgtcatgcccttcccggcccgtcatgcccctcccgacccgccggccccggaccgggctgtccggtgccgggcttgccggtatcgggtggccggttgccgtggttgttcctccgggagaatgacgatgggtgtccgcccgaggggatgcggggacgggcccgccgatcccctccggcggcgggcccgtgcctcggggtcagcgcttggcttcggcgaccgccttgcggacgacgtcggtgccggcgggcgtcggggcgccgccgaacgggccgtacggggtgacgtagaccggggtgtcccgctgggtgcgccagttctcggcgagcgggccgacgtccaccgcgtcgtagccgatctggtcgaggaactcgatgaccacgagcttcgccgcggaatcgtcaccggcgatcggcagcgcggtccggtccgccgcgccggaggggcgcccgagctgagccaggtgcccgaaccagatgttgttgaagcccttcaccaccttgctctcgggaaggtggcgctgcagcagctccccggtggtgctctcatcgctgtccagggccgcgatctgcccgtcccgctccgggtagtagttgttcgtgtcgatcacgaccttgcccgcgagcggctccaccggaacctgcgggtaagccttcagcggcaccgtgaccaccacgatgtcgcccgccgcggccgcctccgccgccgtagccgcccgcgccttcggcccgagctcgctcaccaggccctgcagcgtctccggcccgcgcgagttgctgagcaccacgtcatacccggcggccaccgcaagccgcgccacggtgccaccgatgttcccactgccgatgagtccgatcgtcgtcatatcagcgcgaaccccaccccgccggtccccgattccacgtcgtgacgggcggcacattcaccattcgccgcggcccgcccgttgaccaccgtccgcgcgtttcccggctagctagctagcccgctcgcctggccgtctgctcgctcgcctgcccccgctcaccgcccgtccgtgcacccgcgccgttcgcgcgatgcgttcgaccgagtacgtcacggcggagcggtcggatggaacgtccggaggcgggcgttcccggtgtccgctcgcccctgagtagaaattgatcatgggtcatgccggctgcggatcagcggaattggttcacagcagcccatcgcgaggccaggtgacacacatggacctgcggtcggccgcggggtggttacggaaacaggcggtgggtggcgcgggccagctcggcgtcgtattcctcgccggggaagtggaggctcggcggaggttccggggtggtgtggccacgccagtcatgccaggtgacctgatcggactccgggtcgcggacgatggtgacgtagagggcaccgcagcagccttcggtgcaccaggcctcggcaagctgcacctcctgtggctcggggtcggcgcgtaactggccctgggccaggaggaacttcggcgggttcggtggcccccggtggaaggcggcggggatcaccggacggccgtcgacgacgatccgggtttcggccggcagaccctcgtccggatcggcggcgaccacccggatgtgaaagccggtgggcggcaccggctcccgccggacatcgaaggtggacggcccaggtccgtgacccaccgggagacgaccggtcagcgcggcgaccagactttgccggtcgcccgcgaacctgtccgggcccggagtgctgtcactgccggcaccgtggacggctgggctgccggtatcggcgattccctcagccgccgggtccccggtggaccagtcggcgcacgctatccggccggtgctgagttcggtggccagctgggcgatcagggaccagcgcgccggggtgcccggcaggtgcggggcatgccgggcgaccgcgcgggccagccgcacgagctggtggaactcgtcgaacccccggctgtagtcatgcggccggccgagccgaagaaccagacgcgcggcccgttcccaggtctcagccgatagcgaagccgcggacagggcagccggagacagcgaggccggggccgtgggcgcggcgggtggtggtgcgggaccggcgagcgtgggatcggcggccggcggagcgggggtgggcggaggcggcaccgctcgcaagggtggggtggtggtgagttcggcggccaggtcgatgacgtcgatggcgtcgcgggccaggggggtgacgccgcgttcgtcggcggcggcgcgggcgcggagccaggcgacggccggtgggtcggcgaggcggcagagggcgcgggcgatgaagtggcggtggacccgggaggagcggtcggcgagccagatcaggtcggtggaggcgcccagcgcttcgagggccgcgatggcggcgtggctgagtgggtctaggcggccgaggaggcggatcggcgcggcgtcgatcggctcgccggcctcggcgagcatggccagcccggcctgggccgggaacagctcggtggcggcgccgatcaggcaccggccggtcagtcggatccgctcgcgcatcccgtcgtcgccggtcagcagcagccggcgcagggtgggacgcagctcgccggccggcggttgctgcgcggccagcgcgtcgtggaactgctgcagccgggcgatcgcatccggcgccgcgaagtacgcgtcgaggagcgcccgcagccccggcctggtggcacgaccgctcggtgcggcagaccccggcgaggtcgcggcaaagaccaccccaccgggcagcggcgcgtccacaggcgccccgggcggccgcgtgccgacaggtgttccgggcggctgcgtcccggagtccggcgacgtgccgaagcggggcgacgtgccgaagtgcgaaggcgtatcgaggtgcggcggtgtgccagagggcggcgccgtgtcgaggtgcgctggtgtgccggagcgcggcgccgtatcgaggtgcggcggtgtgccggagcgcggcgccgtgtcgaggtgcggcggtgtgccagagccgacgtgcgacggcgtatcggagcccggccgcatgccgaggtgcgacgccgtgcccgaccgggtcccgggcggcggtgtgccgaggtgtgtctcgagcaggggagtgtccggtgtcgcggcgtgcaggcgggcggcgtgggtgaacagcgggatcgcgggatcgagcgtgacccgctcgtcttccctgctcatggtcgtggaggtggctcgtttcgctggctcatacgacgaactgtgtcatccgccgatcgcggtccgcaaccacccgcacccacctgtggacaaccgttgtgccccaccgggggatcacctgccccgccggggcggcaggacgccgcgcaccgtccgccgggtgtcgcgccaggccagccaggccgtccgcaggcgcggggaggccacccgctgcccctggcggcgggcgcgcagctgggcgatcagccatggcggcccggccgcggccgccaccgccgcgctcttggtcagcagcgttccgtggatgagcgaatgccgcccccgggccatcgaggtgagggcgagatcggccatcgccgggtccaggaagatccacggtcgatgcccggcccacgcccagtatccggtgagttcggcgtgggcggcggcccgtacgtcgtcgtcgctcatcgccgccagcagctcacccggtgcccggccgaacacggcatatccatgtcggaccagctcagcccgggtaacgccggacaggatgcgccgcaccaaccgcccgtgcgtccacgtgggatggtccgcggtcgggtcggccagccggtccgcggggacgtagacacagcccagtttcagcgccgggtcgcaccctgcgtgcaccgccgcgatctgatccggatcgggctcggtcggcacgatcgccaccaggtcgaggtcgctgaccccggtgaggtaatcgccggtcgcgagcgagccggccaccagcaggtcgcttgcccagccggcggccgccagccggcggccgaactccgccacttcgcgcatacgccattgtgccgcggtgccaccctgggggcatgttcatcggcttgcgcacccgcgacgatccggtcgacgtccgggtgctcacctgtcgctcctgcgggtggacggccccgcaggagcggttcgcgcggaccgtccggttcaccgtcctggtgccgctgttccgggtgcgtccgcggcgcaatctgctgcgctgcggccactgccggggtctgcgtgcggcgaccccggcggtcatggagtgggctggatccagtcgaaggtccgttgcaccgcgcgctgccagttgacgtattcggcgttgcgcaccgccgggtccatcgccggcatccactgtccggcgatgtgccagttgcgccgcagtccgtccaggtcgggccagtatccgacggcgagcccggccgcgtacgccgcgcccagcgacaccgtctccgcggcgaggggccgcaccaccggcacgtcgagcacgtccgcgatcatctgcatgagcaggttgtcggcggtcatcccgccgtccactttgagggtggtcagcgcgaggccggaggtggcgttcatcgcgtcgacgacctcccgggtctgccacgcggtcgcttcgagcaccgcccgggccagatgacccttggtgatgtacgaggtcagccccacgatcacgccgcgcgcctcggagcgccagtgcggcgcgtacagcccggagaacgccggcacgatgtagcagccgccgttgtcggccacggtccgtgccagcgtttcgatctcgggtgcgctggagatgagttcgagctggtcgcggaaccattgcacgagtgatccggtgatcgcgatcgagccttccagggcgtagcaggccggcgacccggccacctggtaggccaccgtgctgagcaggccgtgtcccggccgcaccagttcggtgccggtgttcaggagcaggaagctcccggtgccgtacgtgcatttcgcctcgccgggggtgaagcacgtctgcccgaacagggctgcctgctggtcacccagcgcggccccgatgcgtacgccgggaaatgcctcgcaagcggtgccgaaggcgccgatcgaggccctgacctcgggcagcatcgcgcgcggtatgccgaagaagtcgagcgccttgtccgaccagtcgagggtgtggacgtccatcagcatggtgcggctggcgttggtgacgtcggtgacgtgcgcgccgcgggtcaggttccagatcagccaggtctccatggtgccgcagagcacctcgccgcgttccgcacgatcctgcaatccgggcgtatggtccagcatccaccgcagccgtggcgcggagaaatacgtcgccagcggcagacctgagatgtcggagacatggggggagagcggcgacgaggacaacgagtgcaccagagcgtccgtccgcgtgtcctgccagatgatcgcccgccccaccgggatcccggtgagccggtcccagatcaccgtcgtctcccgctggttggcgatccccaccgccgccacctggtcgagcgtgatcccggcccggcgcagcgcccgcggcgcgagccgttccacgttgcgccagatttccatggcgtcgtgttccacccagcccggccgcgggaagtgctgcttgtgctcctgctgggccagggagaccagctggccgcgccggtcgaagacgatgcaccgggtcgaggtggtcccctggtcgatggcgaccacgtaccgttcggtcacgatgaatcccccctcatgccgtcatcggcgggccgctcccatttcccgggagatcgcccgcgccgcgtcccgcacactggtgaccaggtgcggccgtggggtgtagtggctgtcgcagatccgttcgaccggcccggacacgccgatcgcgccgatcaccagcccgccgtaaccgcggatcggtgcggcgacggcggccagcccgagggtgaactcctcgacgtcggccgcccagccgcactcccgcacctgctccagcgccgcggcgagctcccgcggcgtgacgatcgtcttccgggtgtaaggcgacggtgcagagtcgaggacgcctgcgcggtacgcgatgagcaccttcccgagcgccgtcgcgtgcaacggcaggaggctcccgacgtccagcgtctggaacgtgtcatccggccggaacacgtggtgcacgaccagcacctgaccctcgcagacggtcccgatccggaccgcctccccgctgcgcgccgcgagcggatcggcccagttgatcgatcgggaccgcagctcgttgatgtccagatagctggtgcccaggtgcagcagggccgcgccgagctggtactgcccggaggtccggtcctgctcgacgaagcccaccccctgcagcgtccgcaggatcccgtgggtggtgcctttggccaggtccagggaccgggcgatctcggtgagcccgagccggcccggcccgccggcgagcatccgcaggatcgcggccgctcgctcgatggactgcacggggcccggcatggttcgcactctatgcggttgagccacgacccgccgtaattgatgttcgacaatgccgaccgctgttcgttgctcccggccaccggtcttcctagcgtccaagggcatcggacgaaggagggagcatggccgcacgactcaaagttcccggactgctcggtgagcttctcgcggagttcgccggcacgttgattctgatcctgttcggctgcggggtggtggcccaggtggtggccgccggcatcggtgaccacgacagcatcgcctgggcctggggcctgggcgtcaccctcggcgtgtacgtggcggcgcggatcagcggcgcccatctcaacccggcggtgaccatcgcgctcgccgtcttcaagggcttctcctggcgcaaggtggccccgtacgcactggcccagttcctcggcgcgttcgtcgccgcgctgctggtgcgctggaactacaccgaggtgctcaacgccaaggaccccgggctgaccatcaagacccagggtgtcttctccacgctgcccggcaacggcagcctgccggtcgggcactggggcgcgttccgtgaccagatcatcggcaccgcgatcctgctgttcgtcatcctcgcgctgaccgacatggccaacaccgcgcccggtgcgaacctgggaccgttcgtggtcggcctgctggtggtcgcgatcgggatggcctggggcaccgacgccggatacgcgatcaacccggcccgcgacttcgggccgcgcctggcgagtttcttcaccgggtactcgaccgcgttccgagatcagacaggctatctctacttctggataccgatcgtcgccccgatcatcggtggtgtgctgggcgccggtctgtaccagtatctgatcggacgattcctgccgacggacgagccccaggaggtgggcgagatcccgacggcgcgtgagagcttggaggcgaaccgtggctgacttcgtcggggccgtggaccagggcaccaccagcacccgtttcatgatcttcgaccatggcggcaacgaggtggcccgccaccagctcgagcacgagcagatcctgccgcaggccggctgggtcgagcacaacccgatcgagatctgggagcgcaccgtcgcggtggtccgcaccgcgatgcagaaggccaacctgagcgcgagtgacctggccgcggtcgggatcaccaaccagcgggagaccgcggtgatgtgggaccggcggaccggccggccctactacaatgcgatcgtctggcaggacacccgtaccgaccggatcgcctccgcgctggaccgcgacggccgcggcgacgtcatccgccgcaaggccgggctgccgccggccacctacttctccggcggcaagatccagtggatcctggagaacgtcgacggggtccgcgaggcggccgagcgcggcgacgcgatcttcggcaacaccgacagctggctgctgtggaacatgaccggcggggcggacggcggcaaccacgtcaccgacgtgaccaacgccagccgcaccatgctgatgaacctggagaccctgcagtgggacgacgagctgctgtcgttcttcaacatcccgcggcagatgctgccggagatccggccgtcgtccgacccgaccgggtacggcgtggcccgggtcgccggcccgctcggcggcgaagtcccgatcaccggcgacctcggcgaccagcaggcggccaccgtcgggcaggtgtgtttcgcgcccggcgaggccaagaacacgtacggcaccggcaatttcatgctgctgaacaccgggacgaacctggtgcggtcggagcacgggctgctcaccacggtctgctacaaactgggtgacgcggcaccggtctacgcactggagggctccatcgcggtcaccggatcggccgtgcagtggctgcgcgaccagctgcacctgatcacgtcggcggaccagagcgaggcgttggccgcgcaggtcccggacagcggcggggtgtacttcgtacccgcgttctccggtctgttcgctccctactggcggtccgacgcccgcggcgcgatcgtcgggctgtcccggttcaacaccgacgcgcacatcgcccgcgccaccctcgagtcgatctgctaccagacccgggacgtggtcgacgcgatggcccaggactccggcgtgaccctggacgtgctcaaggtcgacggcgggatcaccgccaacaacctgtgcatgcagatccaggcggacgtgctgggcgtgccggtcagccggccggtggtcgccgagaccacggcactcggcgcggcgtacgcggccgggttggcggtcggcttctggaagtccaccgacgagctgcgggagaactggaacgagtcgcagcgctggcagccgacctggtcggccgagcggcgcgaccagggtcacggccgctggaagaaggcggtgcagcggaccctcgactgggtggacgtggactgatgacagtgctctcacctgagcgtcgggacgccgccctggccgccctcgcagcggccgaggtcgacgtgctggtcatcggtgggggagtggtcggggcgggttgcgccctcgacgcggtcacgcgggggctctccgtgggactcgtcgaggcgcgcgacttcgcctcgggcacgtccagccggtccagcaaactgatccacggcggcctgcgctatctggagatgctcgacttcgggctggtccacgaggcgctgcgggaacgcgggctgatcctgtcccggctcgccccgcacctggcccgcccggtccggttcctgtacccgctgcagcaccgcggctgggagcggctgtacaccggggccggtgtcgccctgtacgacacgatggcctggtcgggcagcctgccgaaccaccggcacctgacccggcgcggtgcgctgcgggcctgcccggcgctgcgcaaggagtcgctggtcggggcgctgcagtactacgacgcgcaggtcgacgacgcccggcacacgatgttcctggcccgcaccgcggcggcgtacggcgcgcacgtcgccaaccgggtcgaggtcgtcggattcctgcgcgagggcgaacgcgtcaccggggtgaccgttcgtgacctggaatacgaccgcaccttcgagatccgcgcccagcaggtgatcaacgcgaccggggtgtggaccgacgagacccagtcgctcgtgggtgagcgcggccagttccacgtgcgggcgtcgaaggggatccacctcgtcgtaccgcgggaccggatccagtcgaccaccgggctcatcctgcggacggccagcagcgtgctgttcgtgatcccgtgggggcggcactggatcgtcggcaccaccgacaccgactgggcgctggacaaggcgcacccggcggcgtccgcgaaggacatcgactacctgctcaccgaggtcaacaaggtgctggcccggccgttggaacgggccgacgtgcaaggggtgtacgccggattgcggccgctgctctccggcgaatccgagtcgacgtcgaagctgtcccgggaacacatggtgggcagcccggtgccggggctggtcgtggtggccggcggaaaatacacgacataccgtgtcatggcgaaggacgcggtggatgcctgcgccttcaacctgaaccggtccgtcgcccgctgctgcaccgaccggatcccgctgctcggcgccgaaggctatccggcactgtggaaccggcgcggcctgatcgccgccggatccggcttgcacatcgcccgtgtcgaacacctgctcggccgatacggatcattgatccacgacctgctcgcgctgatcgaggacgacccgacgctgggccggccactgaccggtgcggacgattacctgcgagccgaagtcgtctacgccgcggccgccgagggtgcccgccacctggtcgacgtcctcacccgccgcacccgcatctcgatcgagaccttcgaccggggcacgtcctcggcggccgaagccgccgaactgatggcccgcgtgctcggctggacccccgcccaacgcgaccgcgaggtggagaactaccgcctgcgcgtcgaagccgaacgcgcctcccaggaacaacagaccgacgaaaccgccgacgccacccgcctcggcgcccctgacgtgatccccctttcctgaaacccgatctccgcggtacggcgtgacggccgccgctccgcgtcacatccgatttccgcggtacggcgtgacccgccgcccgccccgcgtcagcccgcgcgcggcgggcggcggtgcgcgcccccggtcggtagattccgtccccatggacgccagcaccgaggaactgcgggacgcccacgacgtcctctccgagttctatgcgacgcatctggccggggtcctcgacaccatgcccgtcgagcgcgccatgctgaacctgttcgccgaactcaccctgaccgtcggcaccgaggtcgcggacgtgggttgcggcaccggccgcctcctgccctacctggcggatcgcggcctgaccccgcgcggggtggacctctccccgaagatgatcgaggtggccgagcgcgagcatcccggcttcccctacgcggtcgccgacctgcgcgacctccccttcgacgacgcgacgctggccggggtggtgtgctggttctcgctgatcttcctggccccgccggcccggacgccggccttcaccgaactggcccgcgtcctgaaacccggcggctatctggtgaccgccttcaagcacggcgacgggacccgccgccgcaccggccgcagcaacagcctcggggtcgacttcgaccgctattggctctcccccgaggagatgacggcgcgtttcacgcaggccggcctctcgccggtcttccagggccacgtcccgcccgaggagaacgacccgccctacggctacatgctggtccgcagaattaccggctgaccggtcgctcctcggccggccgacatcaccgggcaatggatcgggacgtgcggtctaggtgactttgatcaaggcttggaggacgtcgcggagcgggccggtgagatcggcggcggaggcggaggccagcggctccaggttggtggcgcgcaggagggtggcgccgatggcggtggagaggaggatctgggctcgcagggtgtcggggtcgccgccctgcagggaagcggcctcggagagcttttcggcgaacatgtgcaggaagcggaggcggatccggtcggctcgctcctcgccggaggagcgcaggatgagcaggagggcgtggctggggccggtattgctggactggccgatgatctgctcggcgatggtttccgggatgcgggccgggtcgacgtcaccggcggcggcgcgcagctcggtgaagctggcggtgagggcggcctcgaagaggccctccttcgagacgaagtagcggctgatcagcgcgacgttgacgccggcctcgtcggcgatgtggcggacggtggtttccgcgtagccgatggtggcgaagcggcggcgggcggcatcgagcaggagctgccgggtgcgggccgcgtcccggcggcggggcggggtggaactgctggtcacctccgctagtgtgacgcagacctcctcggcgcgatcttgcggggccgacccggcgacggcccggggcctgctcgccgacgacccggagtctgctcgccgatggcccggcgacggcccggggccgactcgccgacgacccggggccgaccccgaggcggcgcgggagcggtcagctcatgactttggtgagggccttggcgtacgcctgatgcccggccgcggtcgggtggaaggactcggtcaggtcgccggtggccaggccgtggatccacgggtgcgcggtgcagacctcgtgcccggcgaggatcgtgcggccgtcgacgaaggtgaagttcttgcggtgtgcggtgtgctgccggagcaccgtggccagggtgtccgaggtgctgttcagcaactggcggcgggtggggtcgaagacgcacccggtgccgccgccggtgctgagcaggtgggggtagccgacgacgtacacccgggcgttgggtgctttcttgcggatcgcggtgtagagcgtgtccgcggccgtgggcagcgccgaccggatgatcttcgtgctctgctggaccgcggcggagcagtcggcatcgctgccgagcaggcaggtctgcagggtggtggcgaagccggcgtcgttgccgcccgcggtgacggtgacccagcgggtgctcttcgagaggctgccgagctgggtggccaggacggtggcggtggtggcgccgctgcaggcgcggaaggtcagcttcgcggtggggtgcgccttggcccagaggtacgggtaggcgccggtcctgctctgcacgcaggccgaaccggtgtagtcgccggcgccgatgcccgcggcataggagtcgccgagcgcgacataggactgcgtccgggcggtggccgaggccggtgcggcggtcagggcgagcagggcggtgacgatgctgagaaacttcacgaagccatcctcgtactatcaggcgatttttcctgataaacgaggaagagccctggcgcgcgccgggggtggcgcgggccagggccggaaaactacttccaggtgtcgctgatcgtgtacgaggacgcggtgcccgtcgtgtacgagcggttgctgccggactcccacgtcacggtcccggacgagtccttcctgaggtacttgtactggaaggtggtgcgctgcggaagggccaccagccggctccagccggacgccccggtcgatgtcagcgggatcgcgtcggccgtgttccagctgcccagcgaggcgatcgaacccaccacgtacagcccggtcccggtcgccgactcggtgaaggtgaccgcggtcgcgccggcgttggcgaccccgaagctgttggtgaaggtcaccgccgagctgccggtggtcaccgcgcggttcgcgttgctctcccaggtgacgttcccggcggcgtccttcttgaggtacttgtactcgaaactcgacccggacggcaccgcgaccgtcgacgaccagatcgggtatccgccggcggacagggccaccgccttcgcggtgtcccagttgccgagcgcggcggtggagcccacgacgtacaccgaagtgcccgcagtcgtggcggcgtagacgttgaacgtggcctggaccgtgccggtggagctggtgggagaggtggacaccgacggcgacgtcgacggcgacgccgaggagccggacctggcgttgacgtcgatcgccaccgccccgttcgccgggatggtcaccgaggccctaccgccggagacggtgatcgtcgtgccggcgatccggtcgcggtacgcgccgtcggccagcccggtggtgtaggtcgcggtcgacgcgctgccggaccggttgacgccgaaccagccgagcgagccccggctgaaaccgatcacgttgctggcggtgttggtccagttcgacacggtggtcgccgaccgggtggcgttgtgccaggcgaccatgcccttgaccccggcgctctgggtggtgcactgccaggcaccgttggtgcagctggtcgaggtcacgtagccgttggcgtcggcgggcggggacgcgccggtggccgaggtggagaaggcgaaaccgtcgtacacgaacggctggccgtaggggtaggccagcaggaagtagttggccagcagatacgtgctgccgtcctggtaacgcagggtcgagccgttgcgctccaggtcgtggttggtcaccatggcagcggtctggtcgctggtcgcgtcgaggctccacgacgggatgccggacaggttggacagcgtgccgttggcgaactgggtcttcagcccgtaggcgtaggagaagccgagcacgtcgccgatcccggtgtacgcggacggggcgatggcgccgctgccgcccgggatcacctcctgggcgaagtacgggctcctgccctcggtggtgttgtgcagcagcgccttgatcgccgacaggtcggcggcggccatgtgcttggcggcgtccacccggaagccgtcgaccccccagtcgaccagcttgttcaggtatccggcgatcttcgtgcggacgccggtgtcctgcgacttgaggtcggagagcgacaccagctcgcagttctgcacctcggcggcgttcgagtagtcgtcgatctggccgtcgtcgtcgttgcagtagccgtcgttcgggtggtggaagtcgttgtacgagtacggcacggccgggtacgagtatccggtcgcgttgaacgtcgagccgccgtagccgctgccccccgtgttgttcgagccggccatgtggttgatcaccgcatccacgtagacgcgtacgccggcgttgtggcaggtggtgaccatgctggtgaactgcgcctgggtgccgagccggccggagacgtcgtacgacaccggctggtacacctcccaccacgggtgggcgccgtcgctggtcgaggcgagggtgaccgactcctgcggcggggcgacctggaccgcgccgtatccggccgggccgagctggctggtgcaggcggctgccacggagtcgaagttccactcccacaggttcgcggtgacgtcgctgttgttgagcgacacggcggcgctggccgtgccggccaggctgatcccggccacgcccgcgccggccagcgcgaggctggtcacggcggcgagcaccaatctctttgtcatgtggggggcgctttctgctggggacgagtggtgaaacctcttgcagggtgcggcgctggggcgaccagcagcggggatgaggccgctagggggaactccccttgcaagttcttgcagcttgtttcaggaagttaccaagacatgtcgtccttgtgaagggatcgaaccttgtatgtccaaaaagaaaaggcgcccccgttttcgggggcgcctgagtgtctgtcagtgatcaggatggcgggcccagctccggtcccactgccagacgtgcgccgggcttgcggccccggccccagccgatctccttgcggtaactgccgagcagcccccgcgcggtcaggtgcgcctcgtcgcgcagcggcgacccgggctcggccggggtccgcagcggcgccacgaacagcgcgtcggccgggcagtgcgcctcacacatgaagcaggtctggcagtcgccgtgccgggcgatcaccggtacaccgtccgcaccgcggtcgaacacgttcgtcgggcagaccgcgatgcacacgtcacatgtcacgcagcggtccgcggagaccagctcgatcacgacgccaccgcccgcacggcggcctgctcgggccgtacccacaggtcatcgagaccacccacggtcaggcggtggtgctgggccgggtcgagggccgggaagtcctcgcgccgcgccatcccgcggctctcggtgcgcgccagcgcgctggtgtacatccaccgggcgtgcgccaccatcgcggcggcctgccgggtgcggaccgcttgcgcgccgcgggcgccggcgctgccgcgcagcgccgaccagacgccgttcaactcgtcgagggcgggtcgcaaccggtcgccgtgccgcagataattcttgtcgtacgggtggacctgcgcgcgcaccacctcgagtgccccgctcgcgtccgcctggggcggcccgtccgcgcccgcggacaccagccgccgccggtgcgagcccgcgccgagcccggccgcgaagcgtgcggcgccccggcccgcccaggtccccgacgacatcgcccatgccgagttgtggctgcccccgccggtgaacccgccgcagatcagctcccgggtcgcggcgtccccggccgcgtacagcccgggcaccgtggtggcgcagtcgtcgccggcgatccggatcccgccggtgccccggaccgtgccctccagcagcagcgtcaccgggaagcgctcggtgaacgggtcgatgccgagccggtcgaaggggaggaagaagttcggctgcccgatccgcatctgcgcctgctgcccggcgtcggcccggtcgatgctgcacaggacggtcccgccgcgcagcagctcggcggcgatcaccgagcgcccgccctggctgctcgcgcccgccaggtggctgccgtcggcgcggtagaaggtggcgaagttgtagtacgccgtcttggtcaccgaggagaacgcgggggcgatcccgtacgcgttggagaactccatcccggacagctcggccccggcctcggcggcgtagagcgcgccgtccccggtgtccacgtcgcagcccagcgccccgctcaggaacgcgcacccgccggtcgccagcaccaccgccccggcccgcacccggtatgcggtgtcgtgctggcgccggtgcccgcgcaccccggcaaccgtgccgcccgggtcggtgagcagctccagcaccgggctgtggtcgaggatgcgcaccccggcccggcgaatccaggagcgcatccgccgcatgtactccgggccctgcacgccgcgtcggtacggctcgccgccgacctccgggaacgggtagcgggcctcgaccgccagccggttcatgttctcgaaggtctggtccagcacccgggccgcccagcgccggtcggcgaggtggccgccgagcgcctcgcggctggccatcgccttctcgcgctggtccgggtcgggctgcacataccagacaccggtgccgccggacgcggtcggcccgctggtcccgcagtaacccttgtcgagcagcagcacgtcggcaccggcctgagccgcggtgagagcggcccaggcgccggccggtccaccgccggcgacgacgacgtcggcggtgaggtcgagcggggtgggttcggtaggcatgcgcccagcattgaacccactaagcctatctgtcaactaggacattgacgagtgggaaaacgggaccgccatccgagcagcagcagaaccaccgggtcccgaccgcccgcatcgccacgccgccacaccgccggcaccgcccatcgccgcaccgctgtactgctgcactgccgcaccgccccaccgccccaccgctgcaccgctgcaccgccggcaccgcccatcgccgcaccgccgcgccgctggcaccgcatcggatcgcacgctcgcgtcgtgcggacacggtcggcaattgtcgtcgctgtgtcaccggtgtatgtcgtgcgcacctcgggggcttccgctttggtcaagcagatatgaaattatgaaacgctctctgctaaccctccctttcgggtgtgccgccgtgtcaagcccgtcaatggacactgagaattcgtgcagtcgtggtgatttacttttgagatcgcttttgaagtccttgacccgagcccggtgacccgcgtatttcggaaaccatccaatgtcgcctgagtgtcacctcagccactatcgaatcgtaaccaaacttaatcaataaggtcctgctccgagcgaatccgcaagtcgggccctctgttgagaaagcgagaaccgcattttcccgccgagccgcacgccgaaaaccaaccccacaacacgcccctcccgcacacgatcgcagaaaagccccacgagggcgtgccacactcctcgaagccgaagccggagccggagctagctagctagcgggccgggcagcgcgaggcgggccgggcagcgcgagcgggccgggcagcgcgagcgggccgggttgcggcccgtcccgtgcagcgattcggtgtggctgcgcagggccagcggctggaccgttctgggggacggtgacgaaggtgccgcggcccggtgggcgcccagccggccctccatggcgagtgcgctgatcgcccggcgccggctggagcgggccgcgctgtacgccgtggcccgcctgcgttcggcggggagcagggcgctcggagagcaggttgagcagctgcgtttcgaccacgtagtactcggagacccgcgtactcggagacccgcccgtgttcggcaacgccaccgcgaacagcttcgaccggcacacggccgaaccctgcaggcccggccgtgtgccgctggaggttcgccggacgcgcgggcctaggtggtgcggcgccgccgcaggaacacgaagatgccggcgccgaggagcaccagcaccccgattccggcggccaggcccagccacgggccgttccccttgtcctgcgagggtgccgccggagccgccacggtcaccgccgggaccacgctgaccgccgcgatcggcgcgtcggaggcggccgcggaggggctggcctgggccacggccaccgtgaacgtgtacgaactcttgatcacgtcaccgtcgtccgcggtcagctggtacgccacggtgtacttcccgttgcccagtggcgtcccgaaactcaccgtaaccgacttcccggtcaccaccggctcggccaccgcggccccgtccggtccggtaacggtcagtttggtggtcgccgggtcgagtttctccaggaaggtcagcttcacctcggcgggcgccgccgtgaccgtcgcgtttttcgccggcaccgcccccaccagcggattgtgcgccaacgccggcgccgccggcaccagcaccgccacgatcgcggccagaacaaccatcaggcgtttcgtcatgatgtcagcgattctctctctgcaggttgtcggttagtcgccgcatccagcctcccggttcccgcccgtccccctctcgtgaatcaccgtcacggtcaagatcaacttcgattgccggtacgtgatggcacctcttagtcgtttcttacccgcaccgcctggccggtcttagacacgtgggcgactctcgtaccaggcccctcagcctccactgccaagctacggagagttccccccatgtccgacgagaagcccaccaccccgatcccggtgaccccggcgcacgccgaaccggtcgccgaacccgtcgccgagccggtggcggagccggtggccgccaccccggccgctcagccgccctacgtctccacggtcgccggtgggcagcccgcgaccccgcccccgcccccgccgcccggctgggcctacgtgcccgcgggtgcccagctcccgccgcccccgccgggctacgcctacgtcccggccggcccgcagcagtcgccgcgcaccccgtggcgtggccgtcgcgtcccgctgctgaccaccgttgccgccctgctcctgggctgcctgctcggcgtcggcgtcaccgcggtcgccggtttcgccttcggtcaccaccgggacggcggcggccacggccagttcaacggccggggcggcgacggccggggcggttccgggcggggcggcgacgggcgcggcaacggcccctacggcaaccggggcggcttcgagggcaaccgcggcggtgacttcggcccggggcagcgcggcaatgggcgtacgcccgacaatcagaccgtgccggtcaacccgccgtcgggcgcgccgcagtccgcgaccccgacgccgagcgcgtcccgctgaccgccggttggcgcggccgcggccgcaccccggcagggttcggcggcggacccggccacgccgggaccggagcccggccgcctggcgaaaccacgaaacgccgcagaccgcccggaaggatccggacggcctgcggcgtcagagaaaggcgtcagagaaacggcgtcagcgggaagacgtcagagaaacggcgtcagcgagaaggcgtcagcggaagacgtcaccgaggaagcgcccgagagcaggcgccagagaggagcgtcagagaaggtcagcgaaccgtgacgttgaacagcgggctggcggccagcttgcggaacgaggcgagcgacgccggcgagctgtcgatgctgatgtcacggtcgccgtacaggtccttcttggtgtcgaagtagacgatcgccttgatcgccggccgcttggccagctccggcagcacgctgttgaacaccgcggacttgttcacgaccttgccgacccggtggtaggcgccccactcggcgaccatcatcggcttgcccgggtggttgcgcaccgcccagtcgtagaagccgacgccgcccttggccttacggtccagcaggtcggcgaacacgccggcgtggtagtagttcttctccgcgctgacgtacgagtccaggccgatccagtcgaccacgtcgttgcccgggtagaggtccttccaccaggactgggccatccacttctcgttgcccatgtacgcgacgacgctgaccgcgttgctcacgccgtcggcgcgcagccgctggatcacgtgccggaacgaggcggcgaagtccttggcggtcatcccggaaccggcggtcgggatcacgtcgtcctccggctcgtggttgaggaccaggtagaacttctccgggaacttggtcttgatccgctgggcgaacgcgtcgatccgcttgtcctccttgccggcggcgaccccggcccaggtggtgccgtactcgacgcgccagttcatcagcaggacccgcgggtgcgccttgtcccgggccatcgcgatctccgcgtcggtcgggaacttctcgtcacccttgtggtacgtgtggaagatcgtcgcggtgcggccgctcgcccgctcccaggcgcggtgctccacctcgcgcggcttgccggtgaagccgccggccgcggcgccccacagcacgccgcaggtcgggaccagcttggcgccggtgacgcactccttggtggtggtcttggcggtggtcggcgcggcctgggccgaggccggcgcggccgtcgcgatgccgaggccggcagcgagagcggcgagcgtcagtacggtcttgcgcagcgtcgagcgcttcacagtgaatctcccccgagttgtccagcggtgttgcccgccgggcatgggaagaagattccgggaacgcggttgtcacgacggtgcccgtgaaggtgcccgccggttgctgttctccgggccgccgccgcggcccggagaatcgctcaagggtcagtagtcggccgcctccgggtggtcttgagaaatcgccgtcagcacttctgccaggcgacgtggtagacggtgtccaggttgccgtcggaggagtccatgctcaggaagctggtcgccttgcgcgacgaccagccggggttgacccgcagctcgacgttgacgttcaggtaccgctgctcgccgcacggcaggaaggagaacgacccgacctcgaccttgtcggtctgctgccagtcgttgtccatccagcccttgaagttgtgcgggatccgggtggagtgcgactcgccctggaagtagtagaacgccgtctccgacccggtcgccccctcctcgaggtggccgaatccgcggtagtcggccccggccaccgcgtaggtgtagccggacggcacgtgcacgtcgagcgccagctggcagttcttccggtagtcggtgggtttcgcgtccggcccggtctgcgcggtgaagtcgctgtaggtgacggtgaacgcggtgttgtccggggagacctgcacgttcgcgctcttgccggagcagcccgacccgttcgccgccaccaccccgatgatcatcttgtcggtcggtggcggcgcgccgtgccacgcggtggccggggccccggccagggatgtggcgagcaggacgcccgcggtgatcgtgtgcaacatcgatgtcctcctgaaatcgggcagatacgcctgaaaatggaacgtacttttcggcccgcccggagtccggaatttagcgtggcgacccgctccatttgtccgattggcgcagggggagcccggccgtccgggcagaaaatgtccgtttccgggacagggggttaccggggtggtaatcgacgtgatgtccgtctcggtgccatcgtcggggcatgacaatcaaggacatcttcctggacgcgttcggccgtttcgcggccggcgacgtcgacgtgctgcgtcaggtgatccgcgacgacttcgtcaaccacgacccggacaccccgcgtgacaaggacggtttcattgacgccacgatcaacggcccgatcgggtcgtcgaccctcgacctcaagcgggtgatcgccgacgacatcttcgtggtcgcccactaccggctggtcccggccggcggcgggctcggcgaggcggtggcggacgtctggcgcttcgagggcgacctgatcgtcgagcactgggacgtcgcccagccggtgaccgctcccgatcaggtgtgacgggggtgtcggaatgtgaacgacctgcgtcgatcgttgcgcggatagtgcacatagtctatcggtaagataggttcccgcgcatgcgcaagatggttcccgtgtcggccctgtccgtcgccgtgctgctcgccggctgcaacggcggaggtggtggtgaccccaccacctccaccgcggccttcgatccgaagacctgtcagggcggcacgctcaccgtgctcaaccagggtgggatcaaccacctggacccggcccggctctacacctccggcggcggcaacctgccctccctgctgttccgcacgctgaccacccgcaaccggcagcccggcgaggccggcaccaagcccgcccccgatctggccaccgacctgggcaccccgtccgacggcgccaagacctggacgtaccacctgcgcgacggcgtccagttcgaggacggcacgccgatcaccgcggccgacgtgaagtacggcatcgagcggtcgttcgcccccgagctgcccggcggcgcgccctacctgcgtgactggctgcagggcgcggccgactaccaggggccgtacaagcagcccgacgggatcaaggcgatcgagaccccggacgacaagacgatcgtcttccggctgagcaagcccgagggcgacttcccgttcctggccaccgccacccagttcgccccggtgcccaaggccaaggacaccggtgccgagtacgagaagcacccggtctcctccgggccgtaccaggtcgagtcgtacgagccgaagaagtccctggtcctggtccgcaacccgcactggtccagccaggtcgacgcgctgcgctacgcctgcccggaccggatcgaggtgacctccgggctggactccgcggtgatcaaccagcggatctccaccggggccggcgccgacgcgaacgcggtcaccaccgacgcggtggtcggtccggagcagctggcgcagctgggcaccgggtcggggctggacaagcgggtcacccgcggggagttcccgtcgaccacgtatctcgccttcaacaccaagaaggcgccgttcgacaaccccaaggtgcgcgaggcgctgtcgtacgcggtcaatcgcacctcggtggtcaacgcgctgggcggttccgcggtggtcggtccgtccaccaccttcctgcccccgcagaaggcgctcggctaccagccgtacgactggttcccggccggcgacaccggcaacccggacaaggccaggcaggtgctcgccgaggccggcctgagcaacctgaccatcgagctggcccacgagaacgacgacagcgagggcgtcggccccaaggtcgcctccgccgtccaggaagcgttcaagcaggccggcatcaccgtcaagctgaccgcgatcgacaccgccacctaccgcgacgtgaccggcaagccggccacccagcccggcctgtcgctgcagacctggggtgccgactggccgtccggcggcccgttcctgatcccgatcttcgacggccggcagatcatcaccgcgggcggcaacttcaacctggcccagtacaacgaccccgcggtgaacgccgagatcgacgcgatcaacgcgctcaccgacccggccgccgcggcccagcgctggggcgccctggacgccaagctcggcaagcaggccctggtcctgccgctgacccacgagaaggacgtctacctggtcgggaagaacgtcaagaacgcgtacgccgacgggtggcgcgggcagctggacatcgcccggatctcggtcaagtgatccgtgcgctgctgcgcgaccgcggcttcgtcgcgggtgcggtgatcgcggccggcatggtgctggtcgcgctcaccgcaccgctgctggccgcgctcgccgggcaggactacacgacctaccacgacgcgctgctcgactcggcgcgcggcggcgtgccgctcggctcgttcggcggggtcagcggtgagcactggctcggcgtcgaaccgggcaccggccgtgacctgttcgcccgcctggtctacggcgcccaggtgtcggtcggtgtcgcggtcggcgccaccatcctcgaagtgctgctcggcgtcggcgtcggcatcgccgccgggctcggcggccggtgggccgacggtgtgctgagccgggtgatcgacctggtgctgtccgtcccggcgctggtcatggcgatctcgctgctggccatcgtgccgcaggactggccccggccggtgctgctggccaccgtgatcgcggtgctcggctggggcggcaccgcccggatcagccgcggcgagacgctcaccctgcgcacccgcgacttcgtggcggccgcccaggtggccggggcgccgtggtggcgggtggcccggcgggagatcctgcccgggctgaccgcgccggtgctcacctacgccgccctgctgctgcccaccaacatggtggccgaggccgggctgtccttcctgggggtcggggtccgcccgccgaccccgtcctggggccagatgctgtccagtgcgaccacctggttccgcgccgatccggcgtacgtcctactcccggggttgctcttgttcctcaccctgctctccttcgtgctggtcgccaacggcctgcgacgggtcttcgacccccggcagcgggaggtcctgcgatgatcggccacctcgcgcgccggatcgtcggcggtgtgctcgtgctgctggcgctctccgcgctggtctacacgctgttctacctggccccgtccgacccggcgacgctggcctgcggcaagggctgcaccccggaacggctcgccgacgtgcgcgccgcgatggggctggccgacccggtcctcacccagtaccggcatttcctgcagggcatcctggtgggccgggactactcgctcggcccgagcgtgcggcactgcccggcaccctgtctcggctactccttcgagacctcgcagccggtcaccggcctgctgctggaccgcctgccggtctcgttctcgctggcgatcggcgccgagatcctgtcgctgatcatcgggatcggcgccggcctgctctccggcgcccggcggttccgctggctggaccggatcgtcaacgggctgatcctggccggctactcgatcccggtcttcctggtcggtctgctgctgctcctgctcttctgcgtgcacctgcagtggctgccgttccccggatacgtcccgatcaccaccgacccgctgctctgggcgcagaacctgctgctcccgtgggtgtcgctcgcggtgatccagaccgcggcgtacgcccggctgacccgctccggcctgcaggagagcctggccgaggaccacatccggaccgcccgcgcctacggcatcccggaacgccggatcctctggcgccgggccctgcgcggggcactgctgccgctggtcaccctcaccgcggtcgacgtcgccgcgatcatgacgagcgcggtactcaccgagaccatgttcgggctgcccggcgtcggccagctgctggtcggcgcggtcaaccagatcgacctgccggtggtcgtcggggtcacgctgctcaccggtgtcatcatcgtggtcgccaacacggccgccgacctgctctacgccgccgtcgatccccgggtgcaactgcgatgacactgctgaccgtgaccgatctgaaggtgtccttcggcgaccggaaggccgtggacggcctcagtttcgccatcccggccgggggttccctgggaatcgtcggcgaatccggatccggcaagagcaccgcggccctcgcgctgctcggcctcaccggcggcgccgtctccggccgcatcgatttcggcggtacggatctggtggtcgccgatccccgcccgttccgcggcgcgcggatcgcgatggtgttccaggagccgctgaccgcgctcaacccgttccagacggtggggtcgcagatcgccgaggtgtaccggctgcacaccggggcgtcccggcgcgaagccagagcccgggccgtggaagtgctcgggcaggtgcacatccccgacccggcgcggcgggccggtgcgtacccgcacgaattctccggcgggatgcggcagcgcgcgctgatcgcgatggcgatcgcctgccgtccggaactgatcgtcgcggacgagccgacgaccgccctcgacgtgaccgtgcaggcgcagatcctcgacctgctcgacgaggtgcgggccaccaccggggcggccctgctgctgatcagccacgacctcggggtggtggccggctccaccgagcaggtggtggtgatgcggcacgggacggcggtggagaccggggccacggaaaccgtgctgcgcacgccacggcacgcgtacacccgggcgctgctcgacgcggcgccgcgacccggggggcgcgtctacgtacccggtgcgccactgctggagttgcgggacgtccacaagcacttcaagaaaccgcgacggcccgccatccgtgccgtcgacggcgtcaccgtgacggtgcatgccggcgagacgctcggcgtcgtcggcgaatccggcaccggcaagaccaccctggcccggatgatggtcggcctggtgccgccgaccagcggaaccgtcaccttcgacggggtcgacatcgcgcggcggcgcggacgctcggtgcagatggtgttccaggacccgctgtcgtcgctcaacccccgacggaccgtgggggagagcatcgccgacccgctgcggctgcggggcgaccgcgacccgcgccggagagtgtgcgagctgctcgaacgcgtcgggctgtcggcatccgaatacgaccgctacccgcaccagctttccgggggcatgcggcagcgggtcgggatcgcccgggcggtcgccccggcaccccggctgatcgtctgcgacgaaccggtgtcgtcgctcgacgtgaccacccaggcgcaggtgctcaccctgctcgaggaactgcgcgccgaactcgggctggccctggtgttcgtctcgcacgacctggccgtgctgcgccgcatcgccgaccggatcgcggtcctcaaggacgggagggtggtcgagatcgggccgaccacgcgggtgtatgagcagccggagcatccctacaccgaagagctgctggcggccgcgcaccgcctacacgcgggagtggcggtcggcgagcatcgcgcagaatagggcaccctgctcgatggcgtcgtccagcgccacgtggctgtgcgggaagtcgccgaaccagcggcgcggcatcgcccgtttcaccgtcgcccggaaatccgagccgagcaccgccatcgcatacgacttgatgtccagcgcggaatgcgagaacgggctcgtcccggtgaaccggatcagataccagtagacgaacatgaagtcgaagccggccggatacccgacgaagaccggccggcccggcagcgcctccagccagccgcggtaacgctccagggcgacagccggatcctccggatcctggcggcacgccgcccaggcggccggctgggacgcccaccacttcatcgtcgccggatgcccggccgcccccggcagcgtcgccaggttcgcactgaacgtgccgaccagcgagccgtcccgcagatacgccgccgagccgaaactcagcatcgaatgcgggcccggaatcggcccgtccgtctccacgtccgtgctgacgtaaacctccgcgcgtgccatgccgccaacctagagccccgtctcgcccccgggccaccggattgatggcgggggctagggtgggcgacctacagacgggagcgcgatgatgcgagtgggacgactggccgtgaccggcgtggccctggtggccctcaccgggctcaccgcctgcaacgacaaggccgaggcgccggccgcgcagcaggagtccgcccccgccgccgtggccgcacccaccggcgccgccaaggagctcgccgcggcggcgaccaaactcaccgccaccagtggcaaggtccacatgacgatggccggcggcctgtccggcaacggctccttcgacaccgccgagaaggtcgtcgacatgaggatgacgatgcccggcctcggcgacgtcagcgtccgccagatcggcaccgacatgtggatgaggttcggcggtgccgccgccaagaccttcgccggcggcaaatggatgcacatcgacgccggcaggatgcccgcgagcagctcgctgagcatggcgaagaacgacccccgcaactcggcgaagatgctggccgccagcacggacgtggcgaagaccggcccgcacgcctacaccggcacgatcgacatcagcaagacgacgacgctgaccaccgacatgctcaaggccctggagggcaggaacacgaaggtgccgttcaccgccgaggtcgacggcggcggctacctcagccggatgagcctcgacatggatgcggtcacccccggcgccggcaagatcgtcgcggagtattccgggatcggcactccggtcagcgtcgccgccccggccccggccgagacggtcgaaatgcccgacacggccctcaaggccatgggcggctgatcccgcacctggcagcgtcgatgaggttcaccgagctcacctgggccgacgtcgaccccgaccggcaccccttcgacccggacaccgtgctcgacgtggtgcgcgcggtggccccggcgggcggcgtgcccgccccctatcgacatgagcgcggcgtgttcgacgctgccgccgaccgggcgcgctgggactggcagcgggcgatgggcgccgcgctcgtcgaccactacggtccgtgggccctcggctggaacgccgagatcgccggccgcgccgccgacggtgcgctggtgctgcgctggagcggcgcccgggactcgatcacgacgccggaggagacgctggccgccgtcgccggctcgctgctggactggcggaccttcctcgaagaggtggccgagttcctcccgcgccacctgcccctgccggccgagccccgagcggccgccgccgcctgggaagccgccatcacctcgctggtcgcgatggtggccgcccggtccggcgccgacgaacactggtatccggtctgcgcacagaccctcaggtggttcctcgccgtcgccggggtgccggccgccgagcacgacgcgctcatcgacgtcgcgatcggcggccggtacttcagcttcgtcttcccgctgggcgcggaggtggccgacgtcgcggaatcagtggcggcggcggtcaccggcaccacaccggccccggacgacctgtggcccgagacgtggccgcaggactggccgaactggcgcggccggcacctgcccgccgccagccacgtgccgcgggtcccggcgccggtggtcgtcgacgcactcgccgtctggcggcgggtccggcagcaggcccgctgggaacgcgccgaccgggtcaccgggccggcgcgcgccgcccgcgacggcatcgccgagcacttcgccaaacggggatccggcgccgcccacctcctcgccgccctggagctggtacgtgccgacgcggcggggggcggccccctgaccttcgcgcgcctggagacctggcagcgcgaggtgctcggcgtcgccgccgcccggttccgcgcggtgtccgcctgggcgagagccggagccgaacactacccgtaccgcgacgacctgccggactccttcgcggcctgcctcgcggaggccaccgacccggccgtgcccctaccggcccgggccgcccgggtctacctcgacatcgtgcacttccacccgttcgccgacggcaacgcccgctcggcggcgctcgcggtgtacttcgtcctcgcccgcgagggcgtggtgctgtcccgcgcggcaccgctgctgatgacccgctggccggcctccgttcccggcaacgccgaggggctggcggccgtcatcgccctgctcatcagacagaccggtcggcttcagaggtgaccggtcgaccgggccgtggtgagccggcgtgccgcttcgcctcaggagagctggccgttgtagtcgggcagcttgaaggtgcggtcggcatggccgccctgcaggtcgctgacgttgttgccgacgttggccacgatgcggtagccgcggttctcgatcgcgatccgggcgttcgtcttgagcgtcgcatccgggtcgaagtcgaaccatgggcgcaggtagatgtcggtgaccgggtatccggcggtccgcaggttctgccgggtctgccaggccaggagctgggggcgggcggtgacgaagaagacggcggcgcccgcggcttcggcctgccgggcgagggcgaggaccggtgcggtcgccggcgagatcaggcccgggtggtaggtggtctccagcgcggtgttgtcgatgtcgagcacgatcgcggcccggatcgccgggtcgggcaggcgggtgtcgaggtactcctgggcggtgccggtcacggcggtgacgtcggagatccaggtgccgtacggcggcagggcctgcgcggcggcggcggacgccggcctagctagctaggggcggcggcgggcagggcgagagcgagggacgcgcaggcgagtagcgacgccagtccggggccggggtttcgtctcatggggatcaacctagagcgttcgctgcattgaacaccatagatgactttcggtcggtcgaaagatgccggcgaacgccggtaacaacttcggctcggccgaacatctgctgggtgtaggccgagcgaaagagagatccatgaaccccgagccgaactcagcgcgtccgaagcacccccactcgcgccaccggcggcgcatgttcgccgtcgtagccggaatcgccgtggcggtcggtgtgggcggcggcgtcgcgatggccagcggtgtgccgtttgcgaagagcgacaccagcggtggcatgtgtgcccggaccctgtccgcgcaggcggatctgtccgagcccacgggtggcttcgacccgaagcatccgtccagggcctgcgcgcagggctggcatcagatgtggggcgacgggacgccggtgccggcccgcttcgtggcctgctaccaccccggtgcgaacgccggtggctcggtgatctacccggccgaccggttcgccgacgccgctgccgcctgtgcctcgatcggcagcacagcgatcccgggcgtcaaggcctgaccggaccgcgcacgtgccacccccggcgcaggtcggcccgggggtggcccggccaccgtgacgagcttgacgcgacagcgagagaaggcgaggcgacggatgcccgtactccaggaccggccggggcacgatcggcagtcggccgaacggcggctcgaggaattgttccggcttcacgccgacgcggtcctcacctttctgcggcaccgcaccgaccacgaaacggcgcaggacgtcctcaccgagacgttcaccatcgcctggcgcaagctcggcgagatacccgaggatccgcgcggttggctgtacggcgtcgcccgccgcgtcctggccaaccacgtccggtcgcaggggcgcacggccgcggtggtcgagcggatgcgccatgagtcccggttgtcgggcccggacgagtccggcatcgaggatgccctgcaccgccacgacgtgctggccgcgttggccgtcctgccggaagccgaccgtgaggtgctgctgctggccggctggtacgacctgaccggtgctcaggccgcccgggccctcgactgcaccagggcggcgtacgccctgcgactccatcgggcccgccggcgactgcgcggtgtcctcagcggatcggcgaccgcccgcggcaccacctcagccgcacgtccggcacgggaggcgaacgtatgaacgacgaactgcgcgaggtgcggcggacccggcccgcacccgtcgagggctgggcggactccgccgaaggccgcgagctcttcgacaccgtcctgacgcacacccgggccgagcccgtgccccggacatcccggcgccaccgccgccgggcgttgaccatcggcgccgccctgctgctggcggtgggtgccggtggcggtgtcgcggtggccaccggggtgccgttctccccgggtgacaccagcggtggcatgtgtgcccggaccctgtccgcgcaggctgatctgtccccgccgaagggcgccttcgaccccggtgacccggccaaggcgtgcgcggacagctggcatcagatgtggggcgacggcacgccgaagccggcccgcttcgtggcctgccgccaccccggcaaggatgccggtggctccgtcgtctacccggccggccggttcgccgacgccacctccgcctgcgcctcgatcggcgccgaaccgatcccggccgcgaaccgctgagcccttctcaggaggggcaggcggccggggcgaggtcgtacgcgtcgcggaggtcctcggccgggacggccttgtcgaacagccagccctggccgaggtccgcgcccagcccggccagggcggcggcgtcggccgcggtctcgatcccctcggccacgaccgtcgcgccgaccgcgccggccaggtcggccagggcgcggacgaccaccgagagcacgtggtcgccggcgacgccgctgacgatgctgcggtccagcttgatgacgtcgggagcggtggcgacgatgtgccgcagcgacgagaagccggcgccgacgtcgtcgatggccaggcgcatgccgcgggcgcgcagcggggccagcaccgcccgcagccgtgcgtagtcgtcgaccgggtcgtgctcggagagctccaggacgatccggtcgagcggcaaccggctcaggaaggccacgccgtcgtcggtgaagagcgtggccggcgagatgttcatcgcgacatatccggcaacgtcgggtaggtgatccgcggcccgccgcagcgccgcgagttcgaggttctcccgctcgccgatcagggcggcgtcggcgaagacctcgtccggcggctgctgccactcccgggggaaccggctgagcgcctcggctccgctccggcgcccggtggccaggtcgacgatcggctgcaggagcaccaccgggccgccgcgggccagcaccgggcgcagccggcgctctatcgcggcgttgcgctgccgtttccggacgtccggttcgatgatcatcgccgcggcgtgggccagtacccgcatgagcacccggtcgcggtcgtccagcagcgggtcgggagtcaggccggcgccgcagaacgtgccgtacacggtgccgtcgctgagttccaccgggaccgagatgtagctgcggatgcccaccttgagtgcgggcgtcccggcggccgccgggatcgcggcgaggtccgggatcaccggaggcagcgtgccgtcctcgatcgcctggcagagcgaggtggcccggacctgggtcatgccgtcgtgcagcggcaggtccgactcgacgacctcgaggtgctgcaccggcccctccatgcggctcaggaacgccacactcatcccgagcgcttcccgcgcggtccgcaggaggtccgcgacctggtgggcggtttcggagcgttccggcatcgttgtccctcccggggctgcgcttgggtccgacaacctgttcgacaccggacgccggcggctgagcgaatccatcgacctcggtgctcgccgatgaaggggggctacgccgccacggcatcgagtcgcccggaaaaccggtggagggagccggccggtgggcgctaccgtgctgtccatggtcacgcccggtctgcagctgcccctcgcggtggctcccgtgtgcgtgtttcccggcgctgatacgcgagtctgacccttccccaccggcagcagaaccccggggaagggtggctgttccctgcccgggttctgacgtgccccgcctggcgacgggtcgcgtgtcaccgcaatgccttgcatccagtgaggactgagacaaccatggcgaagagccatttcgtacgcaacaagccgcacgtgaacatcggcacgatggggcacgtcgaccacggcaagacgaccctgaccgccgcgatcaccaaggttctcgccgaccgcgacccggtggccaaccggtacgtcgcgttcgaggggatcgaccgggcgccggaggaggcggcccgcggcatcaccatcaccatcgcgcacgtcgagtatgagacccccacccggcactacgcgcacgtcgacatgccgggccacgccgactacgtgaagaacatgatcaccggtgcggcgcaggtggacggggcgatcctggtcgtctcggcgcaggacgggtcgatgccgcagacccgcgagcacgtgctgctcgcccagcgggtcggggtgccgcacctggtggtcgcgctgaacaagagtgacatggccgacgacccggagctgctcgacctggtcgagctggaggtccgcgagctgctgtccgcctacggcttccccggggacgaggtgccggtggtccgggtcagcgcgctcaaggccctcgagggcgacccgcgctgggtggcgtcgatctccgaactgctcgacgcggtcgacgcgtacgtgccggtcccggcgcgcgagaccggcgagccgttcctgatgccgatcgagaacgtgctgtccatctccggtcgcggcacggtcgtcaccggcaaggtggagcgcggcgagctgcgtgtcggtgagccggtcgaggtcgtcggcctcggcccgacgctttccagcgtcgccaccgggctggagaccttcggcaaggtgctggagtcggctcaggccggtgacaacgccgccgtgctgctgcgcggggtgaaacgcgaccaggtccagcggggccgggtggtggccgcgcccggcacggtccagccgcaccgggtcttccaggcccggatgtacgtggtgaccgccgccgagggcgggcggcacacgccgttcgccgccgactatcgcccgcagttctacttccacaccacggacgtgtcgggtggtctcgacctgggaggccgcgacctggtcaggcccggcgacaccctggacgcggtcaccgtgacgctgggcaagccggtcgccctggagcccggcctgggcttcgcggtccgcgagggcaaccgcacggtcgcggccggcacggtcaccgcggtcctcgactgatccatccggaggtggcccggtcgggccgggccacctcacaggtgccggcgggcggctctgaaggtgcgcagacgcaggctgttggcgacgacgaagacggaggagagggccatggcggcgccggcgatcatcgggttcaggaggccggccgccgccagggggagggcggccaggttgtaggcgaaggcccagaacaggttgccgcgaatggtgcgcacggtgcggcgggagaggcggatggcgtcgaccgccaccgtgaggtcgccgcggaccagggtcaggtcggaggcttcgatcgccacgtcggtgccggtgcccatggccaggccgaggtccgagcgggccagggcggcggcgtcgttgacgccgtcgccggccatggctaccaccctgccggatttctgcaggctctcgatgacggcgaccttgtcggcggggaggacttcggcgatcacctcgtcgatgccgaccgcggtggcgacggcccgggcgacccgctggttgtcgccggtgagcaggatcggggtgaggccgaggcggcgcaggccggtgatcgcctcccggctggtgggtttgaccgtgtcggcgacggccagcacgccgcgggcggccccgtcccagccggcgacgaccgcggtgcggccggcggcctcctcctcggcggcggcggtcacgacctcggcggggatggtgaggccgtcgcgctccagcagcgcgaggcgaccgacggtgacctgatggccggccacttcaccgcgtacgccgaatccagcgaagctggtgaaatcgcggaccgcgagagaaccggcggccgcaggggaagcggccgacggagaagcggcggccgagggggagacggccgacgaagaagcggcggccgaggggcaggcggcggcgatcgccctggcgatcgggtgttcggcggcggattcgacggcggccgcgaggcgcagcagctcgtccgggtcctgacccggcgccggacgggtcgcggcgagcgacatctgaccggtggtcaccgtgccggtcttgtccaggacgatggtgtcgacccggcgggtcgactccagtgcctcgggccccttgatcaggatgccgagctgggcgccgcgaccggtgccgaccagcagggcggtgggcgtggccaggcccagcgcgcacgggcaggcgatgatcaggacggcgaccgcggcggtgaaggcggcggtccagccggcgccggcgccgaaccaccagcccagggtggcgaccgccagagcgatgaccaccgggacgaacacgccggagatgcggtcggcgaggcgctggacgttcgccttgccggcctgggcctgctcgaccaggcgggccatccgggcgagctgggtgtcggcgccgacccgggtggcgcggatgatcaggcggccgccggcgttgacggtgccgccgacgaccgtgccgccgggtccgatctcgaccgggacaccctcgccggtgatcatcgatgcgtcgaccgcggaggagccgtcctcgacgacgccgtcggtggcgatcttctcgccgggacgggcgacgaagcggtcgccgggggcgagctgggcgatcgggatgcggacctcgtgggcgtcgcggagcaccgacacgtccttggcgccgagttccagcagggcccgcagggcggcgccggcccggcgtttggcgcgggcctcgaaatagcggccggccagcaggaacgtggtgacgccggcggccgcctccagatagatgttgccggcgccgtcaccgcgggcgatggcgaacgcgaacgggtgccgcatcccggtctcgccggcggtgccgacgaacagcgcccacagcgaccagccgaacgcggccagcgtgccgaacgacaccagcgtgtccatggtggcggcgccgtggcgcagattgatcgcggcgacccggtggaagggccagccaccgtaggtgacgaccggcgcggccagggtcagcgacagccactgccagtggtcgaactgccaggcggggaccatggccaggacgacgaccgggacgctgagcacgacggagagcaggagccggtcccggagcggatcggacacgtccggtgtctccggcgcggtgaccatcggcaggcgcgcggtgtagccggccttctccaccacggcgaccagatcgtcggcggacaccgcgcccgacaccgtggccaccgccttctcggtggcgtagttgacggtggcggacaccccgtccacccggttcagcttcttctcgatccgggaggcgcaggacgcgcaggtcatcccgccgatttccaactcgatgagcatcgcgccctcctcagtcgtgccggtgtccgccggtggtggcgtcggcggtgaactcggccaggtgcaccgtgccgccgtgccggaattccaggaagagccggtagaccccgccggacgggaccgtcgcgtcgacggtgacgtccgagccggcggtgctgccgtcctggggatgcatgtgcagataggccagatcaccctgacgcagcgcgaccacgtgcccgaacgtcccgagatacggctccagcgtgaccggctgaccgtctctgctcaccgacatggtgacccaggcgggagcgccggcctgcgggtcaccggcccgggtcaccgtgtagccgtcggtctcgaccgcccagccggacgccggcagtggccggggccggtagtcgccggcggccgggatgtcggtaccgagcacgaggttccgcgcgaccgccaggggggtgaagtcggtgaacacccgatactgccccggctccggcacggtcagcgtggtcgaccaggtgccgtcggcggcgcgtaccggatgcagatgttgatagtcggcgaggtcgcgccggaccacgatgaggtgcagatcgccggcgaaccgggtgaccgcccgtccgtccgggccgaggatccggaaggcgaacggctgcgcctcgccggccgcgaaagagctggtcagcgggctcagcgtatacccctgctgggtaacctgcaggccggccggaagcgtggtctcatgtccggaatgtgccccggcggtgtgcgccggcgcgggccgcggggcggtcccgaggagcttgccggcgccggcggcggcgccgaagatcaggatcaatcccagcacgtacgcggtgaaccgcaccgaactcctcatgcctccaccatacacatacccccggggggtaccaagcggattggctcaggggcgcagggcggtcgccgccgagtcgaacagcacctccaggggcaccgccccgttcgctcgcgtccacgcctcgccggccacgtcgaggcaggtgatcacgcaggccacgagggcctcggcgcggacgtccaggggatcgtcgggatcggccccgagccgccgccgcagctccgggaccagcgactcctgccaccgcaggtgtttctcgatgtgccgggcgcgcagtgacggcgtctcatacatcatccgggagatcttcagcatggtcgccgcgtcgtacgtctcctccttgatggcgtggaacgtgttccgcagcgccgtccacggctcctcgtcctcgggtcgctcggccagcgcccgcgcggccaactcgccctgcgcggccagatcgccgagcaggatgtcttccttggtgccgaaatatcggaagaaggagcgccgcgagatgccggccgccgccgcgatgtcgtcgatcgtggtggcctcgaagccgcggctcaggaacaggtccatcgccgtgcgcgcgatctcgtcgtagaccgcctggcgggtgcggttccacagggtcggctcaggcatgccccagtctaacatgcgatgacaggttggcactgagtgtcagtcaggcatacgatgcacggcatgagcgtcgtcgactaccgcaagcagaccgtcctgatcaccggagccagcgccggcctgggcgccgagttcgcccgccggctcgccgcccgcggcgccggcctggtgctggtcgcccgccgcgccgaccgcctggccgcgctggtcgccgagctgtccgcgcccgggatcaccgtcaccccgatcgccatggacctggccgtcccgggtgccggcgagcggctcagcgccgccgtcgaggccgccggggtcaccgtcaccagcctgatcaacaacgccggcttcggcaccaaccaggccttccacgaggaggacccggcccgggtcaccgacgagatcaccctcaacgtgaccagcctggtcggcatcacccgggcgttcatcgaccggctgcgcgccggcgacggcttcctgatcaacgtggcgagcatcgcggcgtaccagccgaatccgcgcatggccgtctacggcgccaccaaggcgttcgtgctcagcttcaccgaggcgctctggttcgagtcgcggcacacccggctgcgggtgctggccgtctcgccgggcgcgaccgagaccgagttcttcgaggtcgccgggcagggcgccgacggcggtacccggcggatgcgggccgaccaggtggtcgacagcgcactgcgggcgctggaccggcgcacctcgcggccgagcgtggtcaccggcgcgctgaaccgggtgctgaccggggcgacgcgcctggtgagtcgccggttgctagccaccgtcgtgggcaccttgttggagcgatccgcggatgcgagaatcagcactcgtagtgcatgatcttcggatggcgacgttccggtccgatgacggtgtggagatctactacgaggtgcgggagggcggcgacggcgagcgcccgccggtgctgctgcaccacggcttcatcgccgacgggcggaccaactgggagctgcccggcatcgtcgccgccctgaccggcgccgggcggcgggtggtcacgatcgacgcgcgcggccacggccgctccggcaaaccgcacgatccgggtcggtacggcgaatcccgcatggccgaggacgtccgagccctgctggacctgctcggcgccaccgaggtggacctggccggctattcgatgggcgccatcgtcgccctgctgaccgccacccgggacacccgggtgcgccgcctcgtgatcggcggcgtcggagcggccgtcgtcgagctgggcggcctggacacccgggtggtcggcggcgagtcgctgatccgggcgctgcgcaccgacgacccgtcgaccatcggcgacccggccgccgcgggcttccgcgccttcgtcgaggcggtcggcggcgaccgcctcgccctggccgcccacgccgccgcggtgcacgccgccccgatcccgctggccaccatcaccgcgccgaccctggtcctggccggtgggtcggatccgctcgcggtccgccccgaggtgctcaccgcggcgatcccgggagcggtgctgcgcaccgtccccggcgaccacctgtccgcgctgcgcgacccggccttcaccccggcgctgctggagttcctgaacgcataggcgaccggggggagtgcccgggcatcgatcgactgaagcggagctcggcgggccggcccaccgctcactgcccgtcagacgcggcggtgccaccacaccgcgccggccggggtggtcgcatcgtggtgggtgcggcggcggaggacctcgtccagcaggtccaccgccgcgcgcaggtcccggccgggtcgcccgccgagggcggtcatcgcccgctccaggaccatccggtcctgggatcgatcgcagcaggggcaatcgtcgtcgaggtcgaagaggcgggcgcgcgggccgtgcacggtgcgccgccagccccgcagggcggtggcgacggcacccggccagaggcgggtgcgctccagctcgcggatcgcccggatggtcggcgacggcagcccgtcgatcgccaccgtctcgtcacggcgcggttgtgcggcgcgtacggccgcgggggagttacgccccatcgcccatcatgatcgtcatggcgccgatgctcgcacgccggtcggtcccgggccagcggttcacgccccgatgaaccggtagtcgtgggtgatccggccgtccggagcgggcagcaggacctccaggccggtggcggcgaccgaaccgtccgcgcgggccaccgcacccggacgcctcgccccgcgcatcgcggcgcgtcctcgatcggctgccggcggagtccccgctgatccgggagatgaccaccctggtgccgggaccgcggcggcaccgagccgttcagtcgccggggcggccggccagggcctcggcggccagctccaggaggccgtccacgctgtcgccgcgggggatcggctccgggtccaggcagcggtccagcagcaactccaacaccgccgcctggtccaggatcgggcgggcgctgatcgcgccgggcagaatccggatctccacggtgttgcgcagcggtgtgtcggtgagcagctgggtcaggttgacgtcgaagaacttggtcagctcgccctcggcggccgcggcccgcagctgtgccgtcgtcgggacgccctcgaccgctcggaccagcggctcgggcagcggggcgagacgccggcaggccgggttggtgcgcagcaccgcgcgcagcggctcccgccagtaggtgaacagccgcacgaggttggacagggcgtgcggcatccggaacggcgccccgtccacgtgcaggtgcacggccgcttcgtagggcacggtgaagcccagctcccgcgccggcccgagcagctcctccagcgccgtctcgaagccgccggtcagcggcggggtgacgatctcgcaggggcgttcgcgttccccgccgagcggcgcggccagcgcgatcgtggcgtcggcggcgtcgtcgagccggtagtagtcgccgagctgctgcaccttgcgaccccacagctcggccgccggcgccagcgcctggtcgatggtgccggccgggtcgctgtgccgggccagcaggcgcagcagccgggagtcgtcggtcagcacccggaaccagccggcctgcggcggggccgccgggttgagcccggcgaccagggtgatgtcgtcgaccagggtgcagagcaggtcgccgtccgggcggcgcacctcgaaacccggggtcaggtgcaggaaccgccccagcccggggaccagggacggctcgctgtcggagtgccacaccggccggacactgcccccacagcgtccggccagatccgtggcgagggtgcgccggctgaccccggcgggggccatcagctcgatttcgaagccggtgcgccggcgcaaccccggtgtcacggcttgatcggcagggtctgtccggcgagcagcttcttgccgccgaggaccttggcgtcgtacgccgtcttcaggtgccacagcttggccagcctggtggcgtcggcgatggtgtagtgggcgtcgaagaaggcgctgacccgcttctcctcgatctgttcggccgacgggtgtggcttgatcggcagggtctcgccgcgcagcagcttctcgccgccggcgaccttcgcgtcgtacggcgtcttgaggtgccacagcttggccagcgtcgccgcgtcgtcgacgctgtagccggcgtcgaagaacttggcgaccgacgccggggtctcctgaaccggctgcggcctgatcggcagggtctccccggccagcaggcggcgaccggcctcggtcttgaccccgaggtagtcgtcgggcgacatcttccacagcttcgccagcgcttcgacgtcgtccccggtgtagccggcgtcccagtacgcctgcaggtccttgtcctgctggtcggcgctggaggcggacggcgccggcgaagccggggccccggccacgaagggggccgtggccgaggtcccggtgcccgactgcgggtcgccgggcaggatggccggcaggttcaccacggcggcgatcaggccggcgcccagtgccaccccgccgacggcggtcgcaccccggcgacggtatttgtgtttacgggacagttcgacgacgcgggcgtacacgtcgccggcgtcaggggtctgggactcggtgcgcgcgaaggcctcgcgcagccggtcaccgtggtcggtcacgacttctcctcggcaaatgaaagttctcgctccgactccagccggagcgttcgcagtgccttcgaggcctggctgcgcaccgtcgccggtgagcagttgagcagatctgcgatggtgtcgtcgtccatttgctcgtagtagcggagtacgagcacggcacgttgcttgcgtccgagcgtggccaagcggttccagagggcgtccgactcggcgatccggtcggcgtggtcgtggaccccgccgcgggcgtcgtcgatctcgaccaggcgctctccggcgagatgcaggttgcgcaccgcccaggagcgtcgccaggacaggtactcgttgagcaccatgcgccggacgtacgcctccggggagtccgcgttctggatccgccgccacttgacgtgggctcgggccagcacctcctgcaccacgtcctgggcgagatgacggtcgccggtgaggacgaccgcatagcgcagcagactgggcaggcgggccatcgcgaattgctcgaaggtcacaccgctatcgacgtgtcccgaacccccgttgtgcaccgtcggccccaactttcttcccgaagaaggcccactggacagtcgacccgaccggatgatgccaagcggtcgctacccggcttcgtgaaccgggtccggcggcacccgctattctgcgcggtcgtggtcgggcagccagttgccgtggaagccgaacggcacccggtgcggcaggtggatccgggccagcggcggggcggcgaggtcggtggcgtcgatgatgatcagatcgctggcgtcgcgccccgggtcgtaggcgaacgtcagcagccagccgtcggccgatccggcgggggcgccgccggccggcacgaagaccgcctccccgggtacctgcccggtcggcaggcggtgccgggtggtcgagccggtgtgcaggtcgtagcggatgacggcgctgacgtcggcgagccggcggggaacgttgtcggtcacggcgaagccgtaacgggccggctgcccggtgcgccgatcgtcgatgcgggggaactcgaccgcttcgtcgtccagccgttcctcggcgacccggccggtgcgctggtcgatggtccagcgccagaggtccggtgcggcggcgggctgccccgggcggtacgcgtgctcgtggcggacgacgtgcatgacgatccggtcgccgtcgtcgtgggcgttcagggtgtggaagacgtatccgggatcgatggtgtaccagcggacctccccctgcggggcgtcgcgccgcagcacgcccaggcgcgcctggtaggtgtcgtcccaccggtacggcatgccgccggtccgcgccccgtccaggctgaacagcaccggcaggtccatgaagatcacgtgggccgcggtgaggctgaagtcgtgcatcatcgtgtgcgcggggacgtcgatcgggcggctgagcgacagccggccgtccgcgccggcgcggtggtaggtgaggtagggcggctcgagtccgccgtagccgaagaagtgcatctccccggtggtgggacagaccttggggtgggcggtcatcggggtgtgcaggcggccgccgaagtcgtaggggccgacggtctccaggtcggtggtgatctcgtacggaagcgcggactcgaccagcgccagcagtcgtccgccgtggcgcacgacgttggtgttcgccgggccggcggtgaggtcgcgggtgccgtccgggccgtaggcgcgggcgtcgtcggtcagcacccgggtccgcacccagcggttgcggtaccaggtggcccggccgtgatcgaggcggacgccgtgcaccatgccgtcgccgagaaaccagtgcgccgaggtcccgtggtgggggttgggcccgttgcgcagataccacccggtcagttcggccgggacggcgccggtgaccggcaggtcgagcgtggtggtctccccggtgacgggcgcgaagttgccggcgaggtgggcgggagtcggtgcggtggtcgtcatgatggcggccctttccgggtcgggggtctttcggcgtcgggggtctgtcggtgacggggatcaggagcgtgcataacgggcacggacgatggcggggtagcggcgcgtgaaagcgatcgggatgacgtagagcaggaagacggcgatggtcgcggcggtgcccgcgtggaccgcctgcagcgtggccagcagcacggcggccaccgtgaaggtcgccgcccagaccgccgtgatcaccaggttggtgcggtggaagacggggttgtcccacacctcccggggcgccgatgccttcgcgatgccgagggtgaacggccgccgcgcgaccagcgagccccaggcggtcagcgcgatccaggccagcgacagcgggccggtccacgacgcgatcggggagtgcggctggagcagggccacgaccgcggcgcaggcgaagaacgcggcgttgctgtactccaggacgagccggtcggcgcgggcgccggcgcggcgtgcccggatgatcagcaggacggtggccagcaggccggcgagagcgccgatcgtccagtcggtggccgcggtgaccgcgccgaaaacgatccagggggcgaaaccgctcaggaactccatgacatcctccatattccacttgtgacatgtgaagtatggaatgacaccatgcacatgtcaactgtggaaggtaggatgacgtcatgagcctgcgcttcgcgctgctggggttgttggccgaccggccctccagcggatacgacctcttgacggaattccgcacgtcactggcgcacgtctggccggccacccagagccaggtgtaccgcgagctgaacacgctcaccgaggccgggatgctcaccgtcggtgaggagggcccgcgcggtcgccgagagtatcggatcactgccgccgggcgggacgctctcgacgcctggctgacgacgcccgacagcgccccgtcgtatcggagcgccctgctgttgcgcgtcttcttcctgtccctggccggtccggagcgcgccgccgggttcttccgggaccaggcggacctggccgggcagcggctctccggttaccacgacctcgtcgagtcgcgcacctgggacgccggcaccctggaacgctacggtcgcatcgccctggagtacggcatccgcctcgccgccatgcagcgcgactgggcgatctgggccgccggacagctgcccgatgacggttcgccgggcaactgaccgacggcggtcggcgacggcggcgcaggacggagcgggcgatcagcagcgcgaccgacggcggtcggcgacggcggcgcaggacggagcggcgatcggcagcgcgaccgacggtcacccgagcgaccgccgcggacgggtcaggggcggtggggtgccgcggtgctgccgcggacgaccagatgcgtggggacgaggtcggtgcccggcgcggccggcccggccgcgatctggtcgagcagcgcctgcacgcagcgccggcccacctcagcgaagtcctggtggacggtggtcagcggcggcaggtacgacgaggcgtcggcgatgtcgtcgaagccgacgacgctgacgtcccgcggcacccggcggccgcgttcgtgcagggcccgcagcacgccgagggccatctggtcgttggccacgaagaccgccgtgcaatcggcgggcaggtcgagcccggcccggtggccgctctccgccgaccagtcgccgcggccgatcggcgggacggggcggccggcctcctcgaggacggtgcgccaggcggtggcgcggcgttcggcggagtacgacccggccgggccggcgatgtgccagacggtgtggtggccgaggtcgagcaggtgccggacggcctggcgggcgccgtcggcctggtcggtgtcgaccaccggataacgctcgcccgcgtccgagtcgacgaccaccacgtggacgcccggggggagggcgacggtggccgcgtcgagcaggtgtacctcgatgatgacgatgacgccgtcgacggcgagttcgcccatcctggtgaaggcgccgagcacgttgtcctgggtgggcacgccgaccgggatcagggtgatcgcgtaccccgcggcggcggcctgggtggcgatcgcctcgacggtgcggctgttgccggtggaggacagtccgaacaggatcaccccgagcgtgttgaaccggccgtagcgcagcgagcgggccgcgctgttcggccggtagccgagttcgcgcatcgcggcgaggacctgttcccgggtggcttcgacgacgccgacctggccgttggcgacccgggagacggtctgggaagacacgccggcgagcttggccacgtcggccatcgacacccgttgtttgcggcggccgccgggcacgtcggatccaccgcggagacgctgcgcttcgatggttctcactccttgaccgacccggtgacccgtgtcactatacggcacacatgtttgcgtaaacatttccactcgcggtcgaacatgtttacgtaaacatccctcacggaacccatcggaaggaggctcggtgacacggcgatcctggatcggctggcagttcgtcgccccgttcctcgcggtgttcgcgctggtcttcctcgcgccgatcgcctactcggcctacctgagcctgtaccggaccaggctgatcggtggcaccacgttcgtcggcgcggagaactacaccaaggcgttgcacgacccgcaattctggtcggcggtcggccgggtgtcgttgttcctggtcgtccaggtgccgatcatgctgatcctggccctgctgatcgccctcgcgatcgacagcggccggctctacggagcggccttcttccggatcacgatcttcctgccgtacgcggtgcccgccgtcgtggccaccctgatgtggggcttcatgtacggcagccagttcggcctgatccgcaacctgaacgacctgctcggggtcacgctgcccgacccactcgccccggactacgtgctggcctccatcggcaacatcgtcacctgggagttcgtcggctacaacatgatcatcctgtactcggcgctgcgggtcgtggacccgtcgctgtacgaggcggcggcgatcgacggggccggccagttccggatcgtccgggccatcaagctgccggcgctgcgcggtccgctgctgatcagcacgatgttctcgatcatcgggacgttccagctgttcaccgagccggtggtgctgcggaccatcgccccgaacgcgatcctcacctacttcacccccaactactacgcctggcagctgtccttcggcggccagcagtacaactactcggccacggtcgcggtggtgatgggcctgctcaccatggtcgtcgcctatctcgtgcaggcccgcgccgtacgaaaggcaggctgatggtcgccgcacccaccatccgtccggcggcgcgccggcgaccgcaacccgcagcggccccgccccggcggtccggcagccggacgctgaccgtgctcaccacgctgatgctgctctacaccatgctgccgctggcctggctggtggtcagcgcgaccaagacccagcaggggctgctcggctcgttcggcctgtggttcgaccacgacttcgcgctgttcgacaacatcggccgggtcttcacctaccaggacggcatctacctgcggtggctcggcaacacggtgttctacgtggtggccggggcgggcggcgccacgctgctgtccgcgctcgccgggtacggcctggcgaagttcgcgttccccggccgccgggcggtcttcgcgctgatcctgggcgccgtggcggtgccgccgaccgcgctggccgtgcccaccttcctgctgttcgccaagatgggcatcaccgacacggtctgggcggtgatcatcccgtccctgatgatcccgttcagcctctatctgatgtgggtgttcgccaccgaggcggtgcccgacgaggtcctggagtcggcccgggtggacggcgccggcgagttccggatcttcttctcgctggccgtgccgctgctctccccgggcctggtcaccgccctgctgttcaacgtcgtggtgacctggaacaacctgttcctcccgctgatcatgctgaaggaccgcaatctctacccgatcacgctgggcatctacagctggaaccagcagtcgctcacggtcggtggcgacgtcgtcttcaacctggtgatcaccggctcgctgctcgcgatcgtcccgctcatcgccgcgttcctgctgctgcagcgctactggcagtccggtctggccgccggcagcgtcaagcagtgacccctcccccgacaagtgaaagggatcagatgagaatcacccgccggcacgcgcttttcggcgccgccatgtcgataacgctcctggccgccggttgcggctccgccggcaagtccgacgacggcaccaccaaggcggccgccaccacggtctccgacgccgacgtcgaggcggccctgcaggccggtggcaacctgacggtctgggcctgggaccctaccgtgcagaaggtcgctgagcagttccaggtgaagtaccccaaggtcaaggtgactctgcgtaacgcgggcaccggcaacgaccagtacaccgcgctgcagaacgcgatcaaggccggcaccggcgtgcccgatcttgcccagatcgagtactacgcgctgccgcagttctcgctctcccagggcgtcaccgacctgaaccagttcggcgccgggtcgctggacggcacctttgcgccgggcacctggaactcggtgcacgccggggagaagatctacggcctgccgctggactccgggccgatggcgctgttctacaacaaggaggtcttcgacaggtacggcatcgaggtgccgaagacctgggacgagtacgccgcggcggccgcgaaactgcacgccgccaacccgaagtcgtacatcaccagcgacaccggcgacgccggcttcaccaccagcatgatctggcaggccggcggacgaccgtaccgggtcgacggcaccaccgtggggatcaccttcgcggacgccggcacccagaagtggacctcgctgtggcagggcctgatcgacaggaagctgctggcgccgatccccggctggagcgacgcctggtacaagggcctcggtgacggcaccatcgccaccctggtcaccggcgcctggatgccgggcaacctggagaccggcgtgaaggcggcgaacggcaagtggcgggtggcgccgatgccgcagtgggcggccggcgacaaggtgacggcggagaacggcggcagttccctggcgatcaccgaggccagccaggccaagaccctggcgtacggcttcctgaagttcgctgcggttcaggacggcgcgcagatccgcaccgacgcgggtgccttcccggccaccaccgcccagctcaacgcggacgcgttcaagaacaagcagttcccgtacttcggcgggcagaaggccaacgagatcctctccgagtcggcggccgaggttgccaccggctggtcgtacctgccgttccaggtgtacgcgaacacggtctacaacgattcggtcggcaaggcgtacaccggcggcgccaagctgcaggacggtctgaaggcctggcaggacgcctccaccaggtacggccgggaacagggcttcacgattccatgagcgattccccgagcgactccccgaagatgcggaacacgacgccccggcgctggctgcgccgcgccggggcgccccggctggagtacggcgccgactacaaccccgagcagtggccgcgcgaggtctgggccgaggacgtccgggcgatgcgcgcggccggtgtcaccgtcgtctcgctggcgatcttctcgtgggcgcggatccagccgcggcccgaggtttacgacttcgcctggctggatgaggtcgtcgacctgctgtacgccggtggcatcgcggtcgacctggcgaccgctaccgcgtccccgccgccgtggctgaccgcccggcatccggagatcctgcccgtcgacaagcacggcaacaccgtgtggcccggcgggcgccagcactggcggcccacctcgccggtcttccgggcgcacgcgttgcgcctggtccgggcactggccacccggtacggcaagcatccggcggtggtcgcctggcacgtcaacaacgagctgggctgccacaacgtctacgactactcacaggacgcggcgctggcgttccggtcctggctgcgcgagaggtatcggacgctggacgggctcaacgcggcgtggggcaccgacttctggtcgcagcgctactccgactgggaccagatcatcccgccgcggcaggccgccacccatccgaatccgacgcagaacctggacttcaaacgcttctcctcggacgcgctcaaggaccacctgatcgccgagcgcgacctgttgcgcgagctcagcccggacgtgccggtcaccacgaacttcatggtgatgggcgagaccagcgcgatgaactatgccgactgggcgtccgaggtggacttcgtgtccaacgaccactacgtcgtgccgcatccgcaggcccgcgacgagctgtccttctcggccaacctgaccgggaacatcgcgggtggccggccgtggttcctgatggagcactcgaccagcgcggtgaactggcagccggtgaacctggcgaagaagccgggcgagctggcccgggactcgctgacccacgtggcgcacggcgccgacgcggtgtgcttcttccagtggcggcagtcgcgcgccggtgccgagaaataccactcggcgatgctgccgcacgccggtcaggacagtgagctgttccggtcggtggcggcgctgggggagcggctggcggcactcgagtcggtcgcggggaccaatcgggtgccggccgacgtggcgatcctgatcgactgggactcgtggtgggtggccgagcacgactcgcacccgaccgaccggctgcggtaccgccaggaggcgctggactggtacacggcccttctggacctgggggtcagggccgacgtcgtaccggcaagcagcgatttctccggcttcaccgtggtgatcgctccggtgctgcacgtggtgccggcggcgctcgccgcgcgattgaactccttcgtcacccagggcggacatctggtctgtacgtatttttccggcatagtggatgagaacgatcaggtgtggctcggtggataccccggcgcgctgcgtgacctgctcggcatccggatcgaggagttcggcccgctgctcgacggggagaccgccgagctggacaacggcacggtcggcacgctgtggaccgaccgggtcgacgtcaccgatccacacgtggcggtcctggcccggtacaagaccggtgaccaggcggaacgtgccgcgatcacccggcgtgcggtgggcgccggctccgcggcctacgtctccacccggctcggcccggatggtctggccgcggtgctgcccggtctgctccaggccgccggagtgaccagcgaactcgctcctgagctgcgcggacgtgtcgagctggcgcgccgggccaggcaccgattcctgatcaaccggaccgccgaaccgatcgacctgggcgcggacggcatgctggccggccgcgacgtgaaaatcattcaggattgatcttccgagtcgctcgcgccggtcgccgcccacacccccttgaggcggcgcccggcgcgagttccgtgtgccgcctcgggggccttgacgcggcacaccgttccggttcgatccgtcacgcgcggcggacggtcgatccgtcacgcgcggcggacggtcgacccgccgcccgcggcggacggtcgatccgtcacgcgcggcggacggtcgacccgccgcccgcggcggacggtcaatccgccgcccgcggcacgagcgccagcgccgcctccggggcggactcgtcgagcgtgagccggtcgccggaggcgaccacgaaccgtttcggataattgctggatcgcaacgccagggcggcgcccgagcgaatcgtcacgggacagaaagtggcgtccgcggcgaagagtccggaaccgtcgcgccgttgcagtttcagcacgaagttctggtgccgaaggaaatagccaggatagttaacagattcaagcgaaacgcatctggaatcattcaagcctttacgcacggtaaagctggagtcggcgcggtcgaggacggaactgcccggcccgatcggatcgagccggccgaggaagttccggtgccggacccggaagccggtgcggtcggcgaccgtcagcgcctcggtcccgccgacgctcagggtcaccgctgcgggggcccgcctcgtcggcccacctttgggagcgctcccggtggcggtgggccgtgaactggtgttagacgccaccgggacggtctcgaccggcgacggcggccggggcggcagcgagaacgggaccacggtgccggccgggtccggcgcggccacgaacgccgggtgggacgccgggtcaccgaggctgaccgcggccaccacgccgacggtcgcggccccggcggcggccagcgcggcacgccgccgccacggcatggagcgacggttccagccggcgaaataggggatcgggggtggggggaaatcggtcggggcggtcggccggatcagcggcttgcgggaccgcgcgtcgggagaatacggcggcacccagccgccgacccgcaaccccgaccgggagtcgtcttccggcatgcaattcgcttcctgaggggatcgagcaaagggaatctttgtcgggttgcagggggatttcaagagtcttgcgagcattttccttgcaacgcgtacaaatctctgaacccggggccgaaccgaacctgtcgcgcgtgcgtatacctcggcggaccacccggcgtggacatggggtgccggttggccgcactgaggagacctgcgtggaaagtcccgttacgccggaaccatccgggctgccgccgacgctgccccgcatctcggattactggcccgacgcgccgcaccggctcgggccgccggccgacgtctacgagctgcccggggtcgaggcgacacggacgggaacgccggccggcgggcttgcgggagaccccgccccaccggacggcacgcgctggatcggcgcaccaccggaaccgcgtaccggccgggactggaaacccgtcgtcttcctcgtggcggtggtgatcctggtcagcggcggggtgctcgccgcgctggccgccgtgcggtccagcggcgaggacgccggcagcctgcccgccccgccgctgccggtgccgaccgtcggcgggaccccgccggccaccccctagctagctaggccgccaccaccgccgtgcccccggcgcccgccggcccggcgctgccggacaccgccaccttcgagctggccgacggcgtcgcgcagctgcgcgtctcgatcggcgacgtgcccaggggcctggtcaaggtcagcgtcgggaagaacagcaggatcgccgcgcggaccacggtcagcggcggcacggtgcgggtcgacgtcaggccgaacggccgcaggacgggcaccgcccggctcgaagtgctgctcaactcgtcggtgacctggtcgttgcggatgcgcggcggggtcagcgaggccgggatcgacctgtcccgcggcaggatccgctcggtggacctgatcggcggcgcggccaccgtcgacctgtccgttcctgatcagcgcgcggcgatcccgatcaccgagcgtggcgggatccgaacctggcggatcgtcaccgaaagcagggtcgcggcgcgggtgttcctgcgccggggagccggggtggtcaccctctacggcgacaccgacgccggcgtcgaccggggcgtgaccctgcggtccgggcagggtgacggcggcatccgggtcgattcggagggcggcatcggcgccctgaccgtccaggcccgctgaccgctggggcagaatcgcggacgtgacacgtactcagggtgacgccctgccgccggaggcgtcctactcactcgaccacttcatcggcctgtacgaggcgaaaggcgacccctgggacaacgccaccaaatggagcgaccagcgtaaatacgcggtcgccatggccagcctgccgcagccgcgataccgccgctgctacgagccgggctgcgcggtcggcgtgctcagcgtgatgctcgccgcccgttgcgacgaggtggtcgcggtggactgtgtggacgaggcggtggtccaggcccgggcgctgaccgccggactgccgaacgtccgggtcgagcgggcgctgctgccggccgagctgccgggcgggacgttcgatctgatcgtcgtcggggacctgctctactacctgtccgcggcggatctgcagacgatgctcgacgggatggtggagcggctggaggagggcggggacctggtgtcggcgcatttccgggatcggctcaacccgggaaactatgacgggttcaacgtgcatgaggcgatcgccgcccggccggggttggcgcgggtgatccaccacgaggacgagtggttcgtcctggacgtcttccggaaggtcgcgggttagcgtttcccggcgcccggcgcccggcgcccggcgcccggcgcccggcgccgggccgtcagccggccaggaccaggctcagcgcgcccacccgcttggacttcttggcctcgtacatcgcctcgtccgcccgccggatcagcgcctcggcccgatccccggtacgtccggcggcggcccccacgctcatccccaggtagacctcttcccccgccacgacgaacggcagggcggtcatcgccgcgatccgctcgctcacccccggcaccgccgtctcgccccggcagatcaacacgaattcgtccccgccgaaccggctgaccaggtctccttcccgtacgcaggcgcgcagccggtcggccaccagggtgagcagctcgtcgccggcagcgtgcccgagccggtcgttgaccggtttgaagccatccaggtcgccgaagaggacggcgaggggttcggcggacatggtggctgtgctgaggtggtcgaggcaggcggcgcggttcggcaggccggtcagcgcgtcacgggtggccaggtggtgcagggccttctcggcggcgcgacgctgggcggcgagacgggcgatccggatcatgacgagaggggtgagggcggccgaggagagggcgatcaggatgccgtcggtgggcaggccgaggatcgcgcggccgccgccgaccatcggggtgagggccagcatgacgccgagaaaggtgagccggccgcggctgatctcgtcggcggggcggtggccgggggtcacccaggtggtgatcgacgggtgcagcgcggcccagccgagtacggcgtaggcggccaggtacaccatgttggtccagtcggcccgcacgccgtccgggccgacggcgagggccgagaccacgtcggcgaccagtaccagggcgacgctcgcggtgatcagccagacggacgccgagcgacggccggccatcgagacgcgcagcatcgcgcccagtgtcccggagatcatcgtcagcccgaggaacatcgacagctgacgtggcgtcgactggtgctgggcggacatggcgggcagcagcaccgcatcccagagcaccccgccgagcgcgaccgcggtgatcaccgagtcgatcaccccgccgatgtcgccggcgccgcgcagtctgaccacggcgatcgccgaggtcagcaggcacagcccgccgccggtgtagaacagttcggccaggctgccgtcgccggtggcccggccgccgacctcgaccagcacgatccagatcagattcccgatgttgtacgacgtgagcgccgccagcatcaaccaccacggcagccgcgcgccggccggggcgcgacgcagggcgtagccgaccgcgggcagtgccgccccgagggtgaccgccaggtacggccactggcggtcgtcgaacggccacgccagataggtcgccaccagcagcgtggtgaccgcgacgtagcagcggagcagcatgtgggtcagatcggcggtcaccggggccggttgaggctttcctccgaccgggtgctcttcgagtaacccggacaaaaatagcgttacggtacgttctgtcacgtccgttcggtgaataaggggtcatgcgcgttcgttccacggtcctgaccggcctgacctgtctgagcctcgccgcctgcaccgcgggcgccggcccgggcccggcgcccgcgccggtcgtctccaccgagccggcggagcagttctatgtggacccgtccggtgccgccgaggcccaggtgcggtcgtggaacgcgcagggccgggcggccgacgccaccgcggtgcgccggatcgccgatcagccggccgcggtctggttcgccgacgccgaccccgggttcgccggccgggcccgtgacctggtcaccgccgccgcggcggccgggcggacaccggtgctggtcgcctactacgtgccgcagcgcgactgtggtggtcactccggcggtggggctccggacgccgcggcctaccgggactggatcggtcagctggccggcgcggtgcacgactcgccggccctggtggtgctggagccggacgcggtcacccacatcctgcagggctgtctgtcgccggaggcggccggtgagcggttcgcgctgctcggcgaggcgatccacgcgttccgggcggatccgggggtgcgcgtctatctggacgccggcaacccgggctgggtcaaggacgtcgaccgggtcgtcgacgcgttgcgcagcgcgggcatcgccgacgccgacggcttcagcctgaacgtggccaacttcgaaaccacccaggccaacctcgattacggtacgtcgatctcggaccgtctgggtggcactcacttcgtgatcgacacgagtcgcaacggaaacggtccggccaccaccgccacgtccggggacggccactggtgcaatccgccgggccgggcgctgggtccggccccgaccacccggaccggccacgatcgggtcgacgcgtacctctgggtgaaacgccccggcgagtcggacggcgcctgcggcgacggcgccccaccggccggtcagtggtggccggagtacgcgctgtccctggccaccaactgattgatcaccgtggcagactcggcggatgcagatcggggtgctcgggcctctcctggtgcgcacgcgggacggcgcgccgatcgatgtgcccggcgcccgcctgcgcgcgctgctggcgatcctcgcgctggaggccggtcgcaccgtgccgaaagccaccctggtcgacgggatctggggtgacacctcgcccgcggacgccaccaacgccctgcaccgcctggtgtcccgcctgcgcaagctgctgcccggcggcctgatcgaggcccatcaggacggttaccggctggccaccgaccccgactcggtcgacgcggtccggttcgaacggctgctggccgccggccgcccgggggaggccctggccctgtggcgcggccccgccatgcaggacgtcggcctcaccggcagtcccgccttcgacgcggcggtcacccggctgcaggagcagcggctggccgcactggagacccgcgacgccggcccggagtcgatccccgaactgaccaccctggtggccgcccacccggtgcgcgagcggctggtcgccgcgctgatgcgcgccctggtggccggtggccggaccggcgaggcactgcaggtcttccagcgcacccgagagacgctggccgacacgctcggcgtggacccgtccccggagttgtccgcgctgcacgtggccctgctgcgcggcgaggcggccggcccgcgggccgccgaccgcggcaacctgcgggccgagctgaccagctatgtcggcaaggacgtcgaggtggccacggtccgtgggctgatcgggcggcaccggctgaccacgctggtcggcccgggcggcaccggcaagacccggatggccaccgagaccgcgcggtccatgctggacacgctgccggacggcgcctgggtggtcgagctggccgggatcggcgcggacggcgacgtcgcccaggccaccctggccgcgctcaggctccgcgacgccctgctcggtgaggcgccggacgcgtccccggtcgaccgggtggtggccgccctgcgcgagcgggacgtgctgctgatcctggacaactgtgagcacgtgatcgagtccgcggccaccttcgcccaccgggtcctcggcgagtgccggcggctgcggatcctggccaccagccgggagccgctcggcatcatcggcgaggcgctctggccggtcgcgccgctggcgctgccggacgaggacgccgcgccggagcacatcgcggcgtcgcccgcggtccggctgctgcgggaccgggccgccgcggtccgctccgacctggtcgccgaccctcgcgcgccggccacgatggcccgggtctgccgggcgctggacgggatgccgctggccatcgagctggccgcggcccggctgcgcaccatgtcgctggagcagctggcgaaccggctcgacgaccggttccgcctgctgaccggcggcagccggaccgcgctgccgcgccaccggacactgcgcgcggtgatcgactggagctgggagctgctcgccgagccggagcgggtggtgctgcgccgcctgtcggtgttcgccggcggggccaccctggaggcggccgagcgggtctgcggcgccggtgacgagaccctcgacctgatcaccgcgctgaccgagaagtcgctggtggtggccgtcggcgagggagcgccgcggtaccggatgctggggaccgtccgggagtacgccgagcagcggctggccgaggccggcgagaccgacgcggtgcggcgggcgcatctggcctggttcaccgagttcgccgagcgggccgagccgcatctgcgccgcgccgagcagttggagtggctggccctgctggaggccgaccacgacaatctgagcgccgcgatgcgcggggcgctggccgccggcgaggccgggccggcggtgcggctggccggggcggccggctggtactggtggttcggcgggcacaaggcggagggctacgagctgctgatggcggcggtcgcgctgcccggcgaggtggccgacgacgtccgcgcgctggcgtacgcgttcgtcatcatgttcgccgggtccgggcacggcgatcagttcgccaccgccgagtggatccggcgggcccacgcggccggccgggatgccggcggcgggcacccggcgctgcgcctggtgaccgcgatggagcggctgctgcggggcacggccgcggccgcgttcgagccgctgctggccgacgacgacccgtgggtgcgggcgctggcccggctgcagatcggcaagatgtggatcgctctgggccacgaggcgaccgacgccgacgcctacctgacggcggcgctgcgcgagttccgggcgatcggcgaccggtgggggatctcgttcgcgctgaccgagctggccgggcggatcgccatgcgcggtgacctggccgccgcgggggagtgcctggagcaggcgatcgcggtggtgaccgaggccggtgcgatcgaggacgtggtgccgttgcggtcccggcaggcgaagctgcactggctggccggggatccggccgccgccgcggccgcgctggccgaggcgcagcgggtcgccggccgggtggcctggccgcacgcgctggtcgagctggccctgacccgggccgaactggccgcctggagcggggacgcggagcgggccggcgggctgctcgacgaggcgatggcgatgctgggcgcggaggccggtcaaccgatcctgcgggcgctcgggcaccacatgcgcggccggctggccgcggatccggacgcggcccgcgagcaccaccgggcggcgctgcgcgcggtgaccgaggccgggcacgcgccgctgaccgcccagatcctgaccgggatcgccggttgggcactggacaccgggcgggacgccgaggcggcccggctgctcggggcggcggtcgcggtgctgggcatgccggaccgctcgcacccggaccccgcccggttcgagctgcgggcccgcgaccgcctcggcgaccgggcgttcgccgaggcggtgcgcgaggggggcggaccggactgggccgagctggccgaggtcacgctcgcttcgtgaaggcggacaccgcccagaggtagccgccgaccccgatcacgaggcaccagccgaccgcgaggatcgcgtcgtgcccggacggcatgccggtgagcagcccgcggagggtctcgatgatcggcgtgaacggctggtactcggcgaactgccgggcacccggccccatcttgtcggccgggacgatggcgctgctgaagaacggcagcatgatcagcggcacggtggccagcccggccgtctccaccgtcctggcggtcaggcccagcgccacggtcagccagcccaccgacacgccgagcagcaccaccatgccggccacgccgagccagtcgagcaggctcgccgaggaccggaagccgagcgcgaacgcggtgccgatgatcgcggcgacggcgaccacgttgttcagcaggctggccaccacctgcccggtgagcaccgcaccgcgggacacgtccatcaccttgaaccggttgatgatgcccttggtcatgtcggcgttcgtcgcggtcgcggtcgcgctcagtccgtagcagacggccagcaggatcatcccgggtgtcgcgtagtccacatagtcgacgcccacactgaacgcgtcacccagcaggtacacgaacatcagcatgatcactaccgggaacagcaccgcgttgaacagcgtggtggggttgcgcagggtgtgccggaagttgcggcgcagcatgatcatcgagtcgctcatcggttgctctccttcggggtgttcccggtcagggccaggaagacgtcgtcgaggtcgggggtgtgcaccgagaactcctcggcgtccagcgcgtacccgccgagccggtcgagcagcgagcgcagcgaccgggtgccgccgtcgccggccacgcgcagggtgagcgtgtcgtcgtcgcgggtggcatcgggcagcacccgggcggccgcgtccaggtcggccgtggtggcgaagcgcagccggacgtggctgcccgggatccgccgcttgagctcggccgcggtgccctcggcgaccagccggccctgatcgagcacggcgatccggtcggccagccggtcggcctcctccaggtactgcgtggtgaggaagatggtcaccccgccggcgaccagcccgcggatgatctcccacatggtgcgccggctgcgcgggtcgagcccggtggtcggctcgtccaggaagatgatccgcgggtcgccgaccagggtcatcgccaggtccagcttgcggcgcatcccgccggagtaggtggcggccagcctgtcgccggccgcggtcaggtcgaaccgttccagcagcccggtggccacgtcgccgcgcacccggcgcaggtcggccatcagccgcaggttctcccggccggtgagcagctcgtcgaccgccgcgaactgcccggtgacgccgatcgtggcgcgtgccgcccgggcctcggtggccagatcgtgcccggcgatccggaccaggccggcgtccgcgccgatcagggtggtcagcacgttgacggtggtggtcttgccggccccgttcgggccgagcaggcagtagacggtgccggccggaacggtcaggtcgatgccgtcgaggacgaccctgtccccgaaggccttgcggagcccggaaacctcaatcgcggttgtcatgggaaggacgatcgcggtcccgggtgtcaccgccctgacagcgccctgacacgcgacccgcgccccgtgacatcgtcacagggcgcaggtcgaagggcggattacgggacgtgtacccagaccgccgaggagggcaccgcatccgtgtccaccacgaagagcatgtaccacccgggcggcaccagtccacggtcgcgggggatctgcacggtgatcccgcccggcccgcggcgcaggggcagcgccaccgatcgctgatccacatcggtcgcgtgggtcaccgcggccggccggatcagccgtgccgtgcggatccggtccgcgtccgggctggggtaggaagcggtcgccccgcgggccacctcggccggcccgccggagatccgcggccgggccccgcggaacaggtagggcgggctgtagatctccacccgctgctcgaagacccccgggttcttgcccgaccggtcgtagatcgggtcaccgcccatggtcaccacccgtccgtccggcagcagcagtccctcggagtggtagtcgcggcccacgctgggcgccgccgcggtccggaaggcgttgcggtacgggtcgtagaactgggcggtgagcaggtcgctgcggttctgcccgtggtacggcccaccgcggtagcccgacgatccgccgctggtgaagacggtgtcgtcgggcagcaccacggtgttcaggtagcgcgtcgggttcggcaggtccggtccggcggtgtagaccgggtgcggccggctcaggtcggcgatcgcggtccgcgcggtggagaccggggagtcaccgaccgccccgccgcccaggatcatcaccttctgccgctgggccggcggcagcagtaccgacgcgctggtctcggtcatcgtgccgtcgcgcagcccggggaccggctggaagtcgttgttcgtcaggtcccacaggccgggggtgcggcccacggtcgccgacccgtacccggcgttcgacccggagtagaacagccgctggtccctggtcacgaagagcgccggataggtggggaagttccgggtcagctgcggcgcggcgacccagcggtgctccctggtcaggtagatctcgttgcgcccgggcagcatccggccgaactgatccagcccggacacggcgagcacgttgccgccgggcagcggggccagcgtcggataccagcggtggtcggtcaggttgccggtccgcacgtaccgttcggtgcgggggtcgaactcgtaggtggtgttgtccccgccgtactcctgtttctctctgttgatcttgtcggcgacgccgtagaggttcttcgcgtcccgcccggtcagtccggcgatctcgtactgcgcgggctggttgatcgactgggtgtcgccggcgatcaccgcgtccacccagacctcgacctcgccggcgtgcaccatggtctggccggcgtgcaccatcttcatcgcggccggcacggtgaccgcggtccgggtcgcgtactgccgcccgtccggcgcgacgaaccgggtgcccttggcgatggtccgcggcccgtggtccggcgactcgttcttgatcttcatgaccccggccgcgaacctgatgttccccggcagcacctcgtacgacttggtgccgccggcgaccagcagcttgccgtccggcaggaaggtgtgcccggagcagaacatgtcggacggggtcggcaccagcgagaacccgtcggtcgccggatcccacaggatggtcttgaacgtaccggcctcgaagttctgccggttgttgccggaccccgcgatgatcaggaccttgccggtgctgagcagcgccgcgtggattgcgttgatcttgaacttgtccgggacggccagcatcgaccagtgcccgtacgcctgcttgtagctctcccggtcgatccggaaccggtggatgcggtcggccgcgaagaccacgatcggctggttcgcggcgagcaccgccgccacggccgggacgatggccagcgtgcgcagcagccggcgggcgagcgagggttgcggtcgggggatcatgcgtacgtcctcacgggttccttggtgcgttgcgcggggatcggggcggcggcgaccggggcggggggtttcgcggcggtcgcccagagcaccggcggagccaggcagagcgccaggttcagcgacggccagagccacatcagaccgccggtacgaccggtcaccaccgcggtgaccagcagggccgcgaacacggcggcccagcacaggtggctgcggaaggtggcgacccggtccgggctggccgaatcgcccttcggggtgaccacgaaaccggcctgctggcgcagcaccgtctggcggaacgcggtcacgtagaccggggcgcacagcgtcgacagcagcatcccggtcaatcccgaggagccggcctcctcgtgcgggctcacgttgtgccgccggttccacaggtagaggccgacctggaagagtgcggcgtccacgtagagcatcgaccacacctgctgcggcacctgtacgccgtgcaccccgaacgcgatgtgcgcgaccgcggtgaccgtgccgagcagccaggccagcgcggtcgtcgggtagtacgccatcagcagcgcgtagtgcagcccgcggcccgcgccgagccgtggcagggcccgccagaacgcgcccgtgcagacctcgtcggtgccgcgggaccagcggtgctgctggctgaagtagtcggtccaggacgacggtccctcgccgacggccagcacgtccggggtgtagacggagcgccagcgccgcccggtcgccgggttccgggtggcgtgcacggcgaggctggtcgccatgtcctcggtgatcgagtcctgcaggcccccgatgctgcgcagggcgctgatccgcaccgcgttgttggtgccgaccagcatcggcgcgcccagccggttgccggcccgctgcagcagcgagtggaacaggtactgctgcgactccgcccaccgggtgaccaggttgtcgtagttgccgtagatctgcggccccaccacgaacgccacgtccggatcccggaaatagcccagcagccgctcgccgaacgacggcagcggcacgtggtccgggtccaccgagacgaacacgtcgtagtcgtcgccgtgcgcgtccacccaggagttgtagttgccgtgcttggtccgcgccttgaacgcgcccttcgcggcattccaccgggtgacgcccttgcggctgaagtggcgggcgcccacgtccgcgcacatcttccggacgtcgtcgtcgttaccctcatcgagaagccacacgtcgtgctcgccgcggatccggacggccgcccggagggtctgctcgaccatggcgaccggctccttgccgggcacgatcgtggtgaggaaggcgacccgcagcccggcctcgggcgggaccggcacgggatcccgggcccgcagcgtggccaggcacagagtgaccacgttgaccaggcggaacaactcgatcagggcgatcgcgccgatcatgacagcggtgacgggggagacgccaccggtcaggtcggccgaggtgagcagccagccgaagaaggtggcctcgcaggtgaacgcgaagatggcgatcaggagactgcggaccgggcgatgatgggccagtcttcgcagtctgacccggtagtcaccgtcggggaccggatccgggggaccggcgaggcggctgaagctgtcgtagtcgtaggccatcttgctccctgagcaatgtggacgcaccgatttaccgatttttcataggtgaaccggatttttccggcacaactggacagtagtcagtgatcgccgggcctggacatccccgctacccgaacggggagaccgcacgggtgatcgccgggcaatctcccggcggttcgccgcggacacgccgaaacccggccggtgaccgccggtcggatgattctgcggctcccctgcgctgcgtgatccgggtccggcgctttgctcggcaaaccttcgaaccgaacggtcctgtgatccgtttgctttgtcgaggcggcgcgaacgtgacccgccggagattcgacaaggcggtggcgatgctgatcctgttcctgctcatcctggttctggccgccgcctgcgtgctcgcggtgcgcggtgtccgggcggaggcccgcaaggccgaggagccgctgctggttccggaatcgttcttcgcaccgcagagcctcgaaggcgtcctctgcacccagctcctcgacggcgacatcacccgccgccaatacctgcgctcgatggccggcatcgcggcccgcgacgaggcccgtcacccgctggtcgtcccgtggcacctgggcgccggcgaggaatagaccgagaccgtcagaagcggtcgaacggccggatcttcgggccgaccgccgagatcagctgcatcagcacgatcagcgtgatcccggcgtacgtgttgaccagcgccagcagcaccccgaccaggtagacggcctgcgccaccacgatccggcggcgcaggccggcccggaaacccggatcccggtcctcgcgcagcagtccggcgccctccgcgtaccgcaggcaggccagcagcagcaggcccaggaccagcaggttcagccagtagacggccagggccagccggaccgtcatgtactcggcgagcagtgccgtcgagaacggcatgaacgacaccccgagcaggaacgtcaggtgcagccagctcagctgccgatccccgcgcgcacagtagttgagttgcgtctgctggccgagccagaacatccccagagtcaggaaactcagcgcgaacgccagcgcgctcggcccgacgtggaccagcgcaccccacagtgcccgctccggcgccaccgcgccggcactccacagtggccgctgccggcttacctctgcggccaccggtacgtgcagatccagcaccagcagcgtcatcgtcacggcgaagatgccgtcactcaacgccgcgagccgctcgacactgccccccgaaatccggtgatacagactccgccggttcgtcgcgtccccatgctccacccggcgaccatgccggaaaagccgcgccgccgcggcccctgggagacgccggacggtcccggccacccgcggtcgggggtcagccggcggtgatccgcgcgtcctcctcggctgtcgactcctggcgggccggttcctcgcgcaggatcgcggcgttcagccacccgtccgggatggcgaacgcgtcgaccagcgtccgcaggtgcgggcggagctccttcagcaggtcgttgatcacggcggtgacggctttggaccgggccggggtgaggcggccgtgttccaggaaccagccgcggtccgcctcgatcgtggtcagcgcgtacaggtcgcagaccttgccgagcagcgcctgcacccccgggtcggtggcccggtcgataccggcgacgaacgcctccagggtgatccggtcgatgtgtgcggtcgccgtcttgagaacgtggtcctggacgtcgttgaagatgtcgaacgggtgatcctttttggacgccgcgccgctgcgcagccggcggatcgcgccctccaggacgtgcttctcccggtcctcgaacatggtcagatgccagccccggtcggtgaccgcgacctcctcatggcggcccgggaccgcgctgaccaggcgctggatcagtccgcgggcggcggtgcgctccaggaccatctcccgcacctgctcggccacgaacgtcgtccggccccagccgtcgagcgagccgaacgcgtcccggtagccggtcagcagccccttcgcgaccagctgcagcagcaccgtgttgtcgccctcgaaggtggtgaacacgtcggtgtccgccttcagcgcgggcaggcgattctcggacaggtagccggcgccgccgcacgcctcccggcacatctggatggtgtgcgtggcgtgccaggtctgcatcgccttcagcccggcggcccgggactccagctcccgctgccggtgctcgtcgaccggttccgggccggcctgcacgtcggccagggtgccgaccagttcctcctgggcgaacaggtacgcatagctggtggccagcgcgggcagcagccgccgctggtgggcgaggtagtcgttgagcaccacctcgcggtcggcgccgggcaccccgaactgacggcgggtgtcgccgtagcgcaccgcgatggtcagcgcggcccgggtcgccgccgatgccgcgccgcccacggtcacccggccgcggaccagcgtgccgagcatggtgaagaagcgccgggtgtcgttctcgatcgggctggagtaggtgccgtccggcgcgacctggccgtaccggtcgagcagcatgtcgcggggcacgcgcacatggtcgaaactgatccgcccgttgtccacgccgagcagaccggccttgtgcccggcgtccccgagggtcacccccggcatcgggttgccgtccgcgtcccggatcggcaccagccaggcgtgcaccccgcggccacgcccgccggtgatcaactgggcgaagaccaccgccatccgcccgtcccgcgccgcgttgccgatgtagtccttgcgggccgcctcgtgcggggtgtgcaggtcgaacgtctcggtcgccgggtcgtactcgcaggtcgtccgcagtttctgcacgtcggagccgtgaccggtctcggtcatcgcgaagcagcccatgatctcggtgtcgatgatcccgggcaggaacgccgcgtgatgccgttcggtgcccagcgccaccaccgccccgccgaacagcccccactgcacgccggccttcaccatcagggacaggtcggcgtacgccagcatctccgccgccaccaccgacccgcccgggtcgtcggagccgccatacgcccgggggaatgccgaagccaccccgatgtcggacggaatctgccggatcagccgggaaacccgctcgcgggcctcgtctccagtctcgccgtagaccgccgcgaagccggccttgccgagctcgtcacgcaccgcccgccggatgtgcgcccaccgcccgtccagcacttcctgcaggtgaacctcatcaagggagtcgccgatcatgccctgaagtcaaacacgctccgaggcgccgggcatgtcggccgggtcgagtgcacccggcgggcgccgcgccgcggcgcgacgccggctctgatccgctggtcagaccgtcgtcatccggagatcgtggaaggtcaggacgaattcgacgacatagaggatgacgatcagccagatggcggcggcgatcaggccgccggcggcctgggggcggccgcgctcgccggtgcggttgatccggcggatcgccaggatgccgaagatgacggcgaccggagcgaggccgatcaggccggtgaccagggcggtcacggcgaacgggtggatctttccggtcggcgggggtggcggatacccaccggggaacggcgggtagccgggcgggtacgcggcggggtatcccgatgccggatagggcggcgggtaggccgcggagtacccgggagacgcgggcgggtaggccgcggggtagccgggaggcgcgggcgggtaagccgcgggatagcccgggggataggccgccgggtagccgggagcgggatagccggacgtgggttcggcaggggtcggtccggggtggggcggctgctcggtcactgcttctccggcgaatcttgctcggcttctggaggcgtcaaggtaccgcggggcgccggaaaatcgcgaattcccgtcggtgggtcgctctacgatcccgggcatgctgaagttgagcttcgtcgagggcgacgcgaccgcgcctgccggcagcggcccgaggatcatcgcgcacgtctgcaacgacatcggcgcctggggcgcgggcatcgtccggaccatctcgcgccgctggcccggcccggagcggatgttccgcgcctggcacgcgtcgccgggcgccgagccgttccggctgggtgccgtgcagctggtgccggtggagccggagctctgggtggccaacatgatcgtgcagcacggcatcgccacccggcgaggtctgcgcaccggctcgggtcacgagcgggacgccgggccgccggtgcgctacgaggcgatccgcgagtgtctcgccaccctggccgtccacgcgcggacccaccgggcgtcggtgcacatgccgcggatcggttgcggcctggccggcggcgtctggagtgagatcgagccgctgatcgaggagacgctcggcgccgccgacatcccgacggtgatctacgacctccggtgagccccgggcggcgcgcccggggcaccgggtggtgcgacctccgctagccgaaccagcgggtgagctgacggttcaggtcgccctgggcggcgccgagccaggcgatgtggccgtccgggcgcagcagcaccgacggggcgtcggccgggtcggtgacgtggtccacgcggtcggaccaaccggtgacgctcagggttccgctgcggtccagcagcagggcccggccccggtgcatcaggtcgtagaggcggccctgcgtcaactccaggtcgggctggcggcggccgagcaggtcgtcgccgaagtcgtagcggatgtccgtggcggcgatcttctcgatcaggtgccggttgacgtcgttgatgtccatcagggtggtgagcaggcggcgcagcgcccgggcgcccggggtcggggcgaggagctccctctgggcccgggtgttgtcgagcacctcggcggccaccgggtggcgttccgagtggtaggtgtcgagcagcccgtccggggcccagccgccgatctccgcggccagcttccagccgaggttgaaggcgtcctggagacccaggttgaggccctgtccgccgatcggcgggtggatgtgggcggcgtcgccggccagcaggacccggccgatccgatagcggtcgacgagacgggtggcgtcgccgaagcgggagagccagcgtggcgagtgcaggccgaagtcggtcccggcggtggcccgcaactcccgcttgaagtcctcgagagtgggtggttccgcgcgggtgctgagagtgcgggcggggatgacgacccggtacgtcgcgggcccggccggggtgagcaggaaacgccggtcggcgcggcggatgtcggcggcccgggcggcgatctcctcgccggaggcggtggcttccagctcgcccatcagggtttctgagcgggacggctcgccggggaaggggacgccgagcagtttacggacggtgctgtgggaaccgtcgcagccgaccaggaatcgggcgcgcaccggctcgccggcgcagaggtcgacggtgacgccgtcgtcgtcctggtcgaatgcggtgacggcgacgccctggcggacttcggcgcccagggcccgggcatgctcggtgagctgctcgacgaggatcggctggcggatgccgagcaggtaggcgtgggtggagtccaggccggtcgggacgggtttgtcgatgccggcgaagaaaccggcggcggggcgctgccggccgtgttcccgcaggcggtccaggaggccacgcatggcgagcaactccaggctgcgcatgtgcaggccgacgatgcggaccgcggccggcggctcggtctccttctccaggagcagcacgcggacgtcgtggagccgcaactcggcggccagcagggcgccggtcggcccgcaaccggcgatgatcacgtcgaacatgggaatgcctttcgggagtgcccggtgacggcgctcccggcgacggtgacgtcagtcgcccgaccgtgacggcgggaggagcacccacagcgttgcagcagtcatgggtcccacctcctcggtccgcgtcacgtcggcagcaagatatcacccgtggcccgacggttcacgtctgcagacccgcgggcacggagcgggcgtcgctgtccgcggtctcgtccgggccggccagggcggtgaacgcggcccacggcaggcggtcgacctgctcggcggtgccggtctcggcgatcgcgcggtaggccagcgacgcggcgcgcatcgcggcgagcagcgcggcgaccgggtgcaggaccagccggacgccggccgcggccagatcgctgtcggtcgaggcgggcggactgccggcggcttcactgcgatcgaccaccagcggtacgccgttgaccgcccggctgatccggtcgagctccccgaggtcgtgcacgccccccgggaggatcgcgtcggcgcccgcctcggcgtaggcgacacagcgccggatcgtctcgcccaggccgtcggccgcgtacgcgtcggtccgggcgatcaccaccagctccggcacccggtcggccagcgccctgaccttggcggccgccggcccgggagcgatcacctcgtggcgccccgtcgcgccggcccggtccggcagccgcagcccggagatgccggcccggtccggcagcggcagcccggagatgccggcccgatccggtaggtgcagcccggagatgccggcccggtggtaggcgaggccggtccacacggcgtgctccgggtcgtcgaaaccggtgtccgcgtcggccagcaccggcaccccgttcagcaccgggaccaggatggacgcccggtcggcgagctgtgtcgcggggacgaagccgaggtcggggcggcccagcatggtcgccgagacggccgcgccggacaggtggacggcccggtgcccggcggcgaccgcgagcgcggcggtcgccgggtcgtggacgccgggcacgtgggtgacccggccggagtgcaggagggcgcgcagagcggtggcggtcatcaggacagtgtcatctttgtcatgctcatcgggctctcccgggtgacgtttgttgccggcctcggccgtgccggatcggctttgatcttgatgatttcgtgaggttacgggagatcagcggggcggtacgctcacgcgatgttcgacgaggctgttgtggtgggtgtcacggcgttctgtgagagcgcggcgccggtgagcggggatgaggtcaaggggaagctgctcagcggcggcgtggagccgtggctggcggagcggctcacctacttcctgccgctcgccttcggacgccgggtgatcgacggggcgtcggtggacgagacgttcctcgacggggagacccggcggcgtctcgaccgggacccggtctaccaggcggcggcccggcgagccctgatcgccgacgaggcggagatcgcccggatcgccgggtacagcagtgaggtggcggcggtcagccaggccgtgcagggcggggcggagctcacgaagctgcgcctcgggccgatcgcgctggaggacgcgctgctgccggtcgggtcgggcagtggcggggtgccgtcgccggcgagcgtgttcgcgcactggatgaccgcgtacggggtgccgatcggcgacgatctgcggctgggcgaggccgagttccgggccaccctggcggcgcatccgcggccggcgccggagctggtggtggcgcaggtgaacttcgcggtgaaccatccggcgctggcccgcccgtggatggtggagagctgcgtcggggtggcgcccacctggaaggaggcgatcttccagaccctcgcgatgttcgagcgggcggtcgcctacccgatgatcgccgccctgctggaccgcggcgcggccggcgacaacgtgcacgtggaacgcttcagccacccggccggcgagttcgacctgctgctcggcgcgcaggtggacctgttcgcgaccgacccggtgccgtccgccgaggcggtcctcgacgagctgctcgccgccctccgggacgtcccgctgagccgggcggtgcacgcgctgcgcttcttcaccgcctaccaggacggccggatgctgaccaacgaggtcttcctcgacggcgaaccgtgggaggccggctcgaaggtgaccgccgccgcccccgccccgctaccgaccggcccggtcggcgtccgcgtcttcgccttcctggtcccggtcggctagcacgtcacccggaccagcggggcgcagtggtcgctgagcagatcaccggtgaacagcagctcacgtgcggcgacgtgccacccgtcgccgctgaccagcaggtagtcgatgcggtgagcggtgctgccggccggcaggcattcgatgcggaacgtggcgcgcgggtcgccggcgaacgggtccgtccaggtgtcgccatcggtgaccgccgaatacagcgggctgtcggcggccacgttgaagtcgccgccgaggatgcgcaacggcgcgtcgccggccgcccgcatcgccgcgtgcagggacctcagctgcccgcgttgcagagcgtcatggcggtttccggtggaccagtcaccgtcccgattggacgtcagctgggtgttgccgagcagcgccccgtccgcggtccgggccgtcagcagaccgcggaaccagcgtcccgccgccgcccggaccagttggctgcgatgtccggcgggcacgccggcgaagcgccggaatcggggttcgctcagcggttcccggccgccgatcgccagaccgctcttgcagacccagttgcggtacgagggcagccgggcccggatgtcgcgtagtgcccgccgcgtccacacctcctgcagcagcaccgcctgcgcgccggagtcctccagctgttcgccgatcgccgccgcccgctcgcgcagcggcggcaggctgttgcgcagcccgacacagagattgagcgataccaccgtcatctgtcgcatgtaggtatcgtccgggtgtgaacgacgatcttctggctgatttcgtccgtgtcgaccgggaacggcgactggggacctacggcatccacgtgtaccgggaggggcacgaaccgctgacccaccggttccggtccgacgaccgggtcaatctgtactcggtgtccaagacgttcacgtcggtggcggccgggctggccgaggccgacggccggttccggctcgacgacctgttcctcgaccacttcccggagcttcgcgggatcgccgcggacgggttcgagcgggtcaccgtgcggcatctgatcacgatgaccagcgggtcgacgcacaagtggttcgccagtgagcggatcgacgcggcggatctgctgcacgagttcctggcggcgccactggacgccgaaccgggggagcggttctcgtacaccggctcggggccctatgcggtgggccggctgatcgcccggaccaccggcgccgacgtgcgggcctacctgctgccgcggctgttccggccgctggacctgcacaacccggcgtggcacacctgcccgctggggttcccgttcgccgagtccgatctgttcctgaaaaccggggagctcgcgcgcttcgcgcggctgctgctgcaggagggcgtctgggagggacggcagatcattccggcggagtacgtgcggcggatgcccgccgagaccgtcgacaccaccgcgatggcgcagcgcgccgcccagttcgggcacggttacggcctcggcgtctggctcagcggggacggcacgtaccggatggacggagcgtacggtcagtatgcgctgatcgacccggagcgacgggtgaccgtcaccgcgaccgcgcacagcgagggcgagcacgaggaagacctgttcgaggcactcgccgagctcctgaagcgcgtcgcgggataggcgatccccgatgcggccagggaggcggagagcgggacccggtatgcccggatcccgcccggcgcgtccaccggactctgcgcccgcgggaggtcatgcggccgcgtgggactcccaggtggcgaacatcgaggcgtagcggccgccggcggcgatcagctcgtcgtgcgagccggattcgaggatgccgccgtcgtcgacgacgatcacccggtcggcgcgacgcgcggtggacaggcggtgtgccaccaggatcgccgtccggccctgcaggaggcgctggacggcggcctcgacccgcagctcggaacgcaggtcgaggctcgaggtggcctcgtcgagcacgatgatccgcggggcggcgacgaagacgcgggccagcgcgatcaactggcgttcgccggaggagaccgactggccgcgctcgtgcaggacggtgtgcaggccgtccggcgagcggtccaccaggtcccgcaggccgaccgcgtcgacggcggcgtccacctcggcgtcggcggcgtccgggcgggcgaaggcgatgttgtcccgcaggctgccggcgaacaggaacggctcctgcgggacgaccccgacctgccggtgcagcgagtcgagggtcacctcgcgcaggtcgtgaccgtcgatcaggatcgcgccgcggtccgggtcgtagagccgggcgaccagtttggccagcgtggacttgccggcgccggtcgggccgacgcaggcgatcgtctcgcccggcgcgatgcgcagggtgacgtcgcgcaggacgggacggtccggcacgtacccgaaggaaacgccgcggaactcgatgccgccggtcgccggcggcaactgccgggcgtcgatgctctccggtacgccggtgaccgtcccgagcagcccgcgcagcttgccgagggccgccctggcctgctgatagttggtgtacagctggaccagctgctgcaccggctggaagaacgcgttgatgtacagcacgaacgcggtcagctcgccgatggtcagctcgccgcgcagcacccgccggccgccgatcgccagcagcgcggccaggcccagcaggccgatcaccgaactgcccggcccgtacaccgcgttgatccgtccggtgtggtcgttggcgtcccggtacgcgccgaccacctcgcggtgctcgaccacgctgcgctgctgccggttgtgcgcggtgatcacgcgaacgccgtacagactctccgaaaggtgtgagaagagagcggcgatcgcgtcgcgctgccgccggtagccgaggtcggcggcccggcggaaccagatcgacagggcggccaggggcggcaccaccagcagcaacgtgatcagcgccagctccgcgtcgtagtgcaccaggacgacggtgaccacgatcatggtgaggccctggatcaggaactgggcgaaaccctcctgcagcagctgctgcaacgcctccacgtcggaggtcatccgggtcatcgtgacgccggccttctccctggtgtagaaatccaggctgagacgctgcaggtgggcgaagacccggacgcgcagatcacgggtgacgtacgcggcgagccggccactctgccggatccgcaccccggaggcgaccgcggtcagggcgaccgcggcgacgaacgccagcgccgagacgacaagcaccgggacgtcgcgggccacgatgccgtggtcgatgccgatctgcaccagcagcgggccggcctgcagcagcaacgcctcggccaggacggccagtgcggcggtgaccagcaagcccgggcggttggccagcagcgaccacagggtcagccggcgggtgtcgggctgttggtggaacggctcgtccggagccggcagcggcggctcggcggcctccaggcgggcgacgccggcggccagctcgggcgggatgccggcgaacggggtgccgctgccgtgccggccggggatggcgtggcccgggccgccgaagccgcctccgaacatgctcatgcgaccggctccttctgggccagaaccgcgctgtagcgcggctcggaggcgagcaactcggcgtgtgtgccgtcggcgaggacgcgaccgtcgtcgatcaggatgacccggtccgcgaggcctatcgtggcgaggcggtgcgccaccatgatcgtggtgcggccggccatcagggcgcgcagcgactcgtggatctcgtgctcgacgcggacgtcgaccgcgctggtggcgtcgtccaggatcaggatcggggggttgaccagcagcgcccgggcgatggcgacgcgctggcgctggccgccggagagggtgtagccacgctcgccgaccaccgtgtcgtatccctgggggagctcctggatgaactcggcggcgccggccgcggtggcggcggcgatgacctgctccctggtggcgtgcgggtgtccgaaagcgatgttgtcgtgcagggagatggagaagaggaagggctcgtcggggacgatccccacccggtcccgcagggtcgccaaggggtagtcgcggacgtccacgccgtcgatctccacggtgccctcggtgacgtcgtagaagcgggcggccagccgggcgatggtcgatttgcccgatccggtggcgccgaccagggccacggtttcgcccggttcgaggtggagggtgaggcccttgaggcccggggtgccgtccgggtaggcgaagcggacatcgtcgaaagagacggcgccccgcggcggcggcgccgcggcctctgttctctcggttatctcggcttctgtatcgagaatgtcgtagatgcggcgggcggaggcggcggctcgctggcccatcatgatgatcatgccgagcatccggaacggcggctgcagcatcaggatgtaggagttgaaggccaccacggtgccgaccgtcgcgtgcccgttcagcaccatcaggccgccgatcagcaggaccagcgccaggccgagccggggcaggttgtccatcaccggcgtccagcggctgcgcagcctcgcgtcggtggcgtaggcccagcggacccggtcggcggccgacgccagggtgtccacctgctgctgctcggccgcgaacgccttgacgatccgcacgccctggatgttctcgtcgaccaccgtggccaccccggccaggcgcgcctggatcagccaggacaccgggaatatcgccttgcgcatccggacgccgagcaccgcgatggccggcatggtcagcatcgacaccacggccagcaacgggttgaccgagatcatcagtccgaacgcgatcaccgcgatcatgcactggaccaggatcgacgggccgaacgtcagatacatctgcacggcgcggatgtcggcggtggcccgggagatcagctcaccggactgcacccggtcgtagaaaccgtacgacatccgcatgaagtggctgaagaccgtgctgcgcaggtcgtactccaactcgtaggccgtgcgcagcaggtagagccgggccagatagttgatcacgccctggatcagcgacagggcggtgatcagggcgacgtagcgggacaggccggcggtgtgcgcgaccagcgcccggtcgatgccgatccggaccagattcgggatctgcacctgcacgaccagcccgacgaaggacagcacgagtgaggtgaccagcagggcgcggtgtgaccggagcagcggccaggcgcgccgcagccagctcttcgacgggtcgggatcgatgccggcccgcggggcacggcgaggggcaggtgacaagggtgctccttaccgatgttgtccttagcctagctaacgatctcggtcgaacggaagtgtggcctcggcaaccgggatgcagccggccgtcactcggaccgcaaccggcgcgctccgatcgtgatggcatgctgcgccgcctcgccaccctcgccgccggtgtccttctggggctcggcctgcccgtccccgcccgggcggcgaccgtcgcctgcgggccggcggcggacagcccgcgctgcacggtgtggatgggccgggtggcctgggtgccggacggcgacacgctgatcgtcacggtgaacgggacgaagacggcccggtccatccggctgatcggggtgcaggccatggagcagcacacgtactcgccacggccggcgaaccggaccggcgaatgccacgccctcgaagcgacagcccgggtcgagcacctggtgcgggccggtggcggtgtcgtgcggctgaccgcgcaggacgcgcggagcaccagccgcggccggccgctgcggtccatcgccgtgcggatcaacggtcgctgggtcgacatcggacaggacctgatcaagcgggggtacgcgttgtggctgccgttcgccggcgagtgggcgtgggacgcggcgtacgcccgcgcccaggcgaccgcgtccacccgttcgaccgggatgtggaacgaccactactgcgggacggggccggcggcctcgatgaccgtgtgggcgaacacccagggtcacgaaggcgagttcgtccggatcgggaacaccggccgccgcgcggtggacctgaccgggtggtgggtgcgcgactcggggctgcggcggtacacgttccggcggggaaccgtggtgcccgccggtgggcacgtgtacgtgcacgtgggcaagggccgggacaccgtcaccgacaggtactgggggctcaacggccagatcttcaccaaccccgacccggcgcgacacgccctgggcgacggggcctacctcttcgatccgcagggtgacctgcgcgaatcgttcctctacccgtgcccgttgcgatgcgcgagcccgttgaccggcaaggtcaccctccgcccggagaacggcgcgatcgcgctggtgaacaccggctccgccgcggtgaacctgcagggccacatgctggtggccgagcggtggcagcaccggttcgacgagaagacgctgctgcagccgggggaggcgctgtccttcgcccggcggcccacgatgcggttgcagaccgccgacatgtggaccgtcgcctcctacagcgacgccgggccgggctcgccgttgcgccagtgacggcggcacagcacccggtaggagaccgccgacgtctccgaggtgtcaccgaccgcgacctgctcgccggcccgggccacctggccgtcgacgagccgcgcgttctgccggcccgggcggccgcaccagcaggtcacctcgacctgcagcgggacgatcacgtcggccagctcgaccagccgctgcgcgcccgggaacagccgggacaggaaatccgtgatgatcgcgtagcagtcgatgtcgacgcccatctcgtccgccgcccaggcgagctgctccacctgctccgggctgaggaactgggcctcgtcggcgatcacgaacccgccggacggcacctgctcggcgaccagcgcggtcagatccattcccggatgcacctcgaccgcgtccgcggtcaccccgagccgcgacgacattatcccctcgcccgcccggtcctggctggtcagcagcaccccgggacgcccggcctggcgacggttgaacgcgttctgcagagccagggtgctcttgccggagcccatccggccggtgaacagggtgagggtgccgaagaccggggccagcgccggctgccgggtggcgagaacggtcgccgcggtgaccggcatcaaatcggggcctcttcctgtcgtcgtccaccccacccgttcggggcgcggccggtacacgctacctggtgaacgaacatccggttaccgccggtcgacggggccgcgtccgccgatcaggcgaccacggccccgtcgatccggactaccggtcggccgtcaggctcttcttgtgcgcggtgacggtctcggcgcgctcccgctcgaacggatcgccgtacgcccggatggcccggcgggcgaacgcctgctgctgcgtggccacccgctccgagcggccgcgcccgatgaagctgaccgcccagtgcagcaccgcggtcacccggttcttgaaaccgaccaggtagaacaggtgcaccgcgacccagaccacccaggccgggaagcccgacagccgcaccttgccgatgctggccaccgccgagaaccgggagatcgtcgccaggctgcccttgtcgaagtacttgaacggctgtccggtctccttcccggcgagccgccgcttgatctggtcggcggcgtgccggccgctctggatggccacctgggccaccccgggcagcggcttgccgtccgcgccggccaggttcatcatgtcgccgagcacgaagatctccggatgtcccggcaccgaggtgtccggcgccacgaacatccgcccggcccggtcggtcttcgccccggtcgactcggccagctggcgggccagcggcggcgcggccaccccggccgcccacaccttggtgatcgacgggatgcggtgccggccctgcgggtcctccacgtcgatgccggtcgagtcgacgccgacgaccttggtgttcagcttcacctcgaccccgagcttggccagctggcgctgcgccccggccgacaggtggtcaccgaacgtgttcagcaccgccccgatcgcgtcgaccaggatgatccgggcctgccgcgggtcgatgtgcttgtactgcccgggcagcgtccggtgggcgagctcggcgatctgcccggccagctcggtcccggtcggcccggcgcccaccaccacgaaggtcagccagcgctggatctcctccgggtcggtgtgcaggtcggcgacctcgaacgcgccgaagatccgggcgcgcagctccagcgcgtcgtcgatgctcttcatgccgggcgcgtggtcggcgaactcgtcgttgccgaaatacgactgcgacgccccggccgccacgatcagcgtgtcgtactccaccgtgtagtcgacgcccggcccgttcaccgagacgaccttgttctcggtgtcgacggcggtcacccagccgagccgcacgtcgacgttgtcctgccgcttgagcacctcccggatcggcggcgcgatctccccctcggacaggatcccggtcgccacctggtagagcagcggctggaagaggtggtacgccgtaccgttgatcagggtgatgtccaccggagccctgcgcaacgccttgatcgcgaagagcccgccgaacccggctcccaccacgaccacacgatggcggcgacctgcttgagtcatagcccgctcctgttcccagtctgtccgcttagtacagcgcacttccgcatacccgtatgccgtgaagatgaccacttcacgtgcggtttctcacctcggcccgcattgagcactgtgagcgcgccacgctgaggcccggctgagcgcggcgcccggcgcggatcgccgcccaccggctggacaggccatccaccaccggttgttccgtaggtcacccggcaccgcccatcccacctgcggcgccgcacgaccacaagaccccgtggaccgtgcgggcgagggtggggaaggatttcccggatggaggagaccgtggctgaatcgccgagagtgctggggatctcgtgggggcggatggaggtcgaggggctggctgagggcaaggatttcaagctctagccgggcggtggccgcgtcgccgtcggtgggctgttccactccacgtgctgaccggccaggtcagtgggcggcaccacgggtcggtccgggtccgtggtcgagaagcaggcggcgcgtcgtcgaattccgggtcgcgcgcgggttcgccgcggcacacctcctgacggtgacgatgcgccaggatggcgggcgttcgcgtcggccgggtcggggctgcaccacaagatctgccacgtgctgggcgggaccttcgggctgccgcacgcgcagacccacgcggtgctcctgccgcacgtgctggcgttgaacacggcgtacgccggcgatcgggtctcggcgatcgccgcggccctgggcgcgccgcggaccgggagcaccgcgaacgccgcgctggccggtctcgcgaccgcggtcggggcaccgcgttcgctgaacgggatcggtctgcgcgaagcggacattccggaagcggtggatctgatcatgccggtcgtgccaccgtcgaatccggcgccggtcactccggcgatcctggacgccctgttgcgggccgcgtggcggggtggtccaccggagtcgccgtcggatcgaaccatgtaacaagggcgatgtaggttaccttcgcccggttcgactggagggggaaacgtgacaacgtccgtggaacggccggccgccgccgaggccgcgccggtgagctcggcgttcaccgcgcgggagcggtgggtgctgctggtggcgagcgcctggctggtgatcggcctgcagctcgacgcatatgcgcacgccacgacaccgcagctggagacgttctggaccccgtggcacggcgtgctgtactccgggatcgcggcgtccggcttcaccctgctctggatcatgaaggcgcggctgcccagcatcccgacctaccagagcctgctggcgctgcccaacgcgctgcgcctgcccctggccggcatggcgtcgctgctggtcggcggcggcgtcgacacgctgtggcacaacatcttcggcatcgagaagaatctggagatcttcgtcagcccgagccacgagctgatcatcctgggcatggtgctggtcgcgatgggcccggcgctgatgaccgccaccgagccgggtcgccggctgggcaccggcggcgcgttcctggtggcgatctccgcgctgttcgcggtgctgcccctgcacatctactcgctgcacgccagcgcgctcggtttccaccacctcggcaccggggtgcgggtgcccaacgtcttctcggtcgacggccagctcgtgcacggctacctgttcagcacggtcctgctgctcgtcccgatcctgatgatcggccgtcgctggccgctgccgatcggcctgccggccgcgctcgtcgccatcccggcgctgctcatgcacctgatgttcgactccgaggcgccctggtggccgcagctgaccgtggcgatcgccgccccggtcgtcgagctcgccctgcgcgtggcgaaccgtctggtgacgctgccggtcaccggccgctgggtcgccctcgggctgatcgcgccgcccgccgtctggggcgccgtgctgctggtcggcaagatccagaccggtaccgtcggctggaacgtgcacatggtcaccgggctgctcaccctcgtcgcgctgaccggcgccggcaccgtgctggtcacccgcagcatccagttcctgcaacgttcgtgaccccgatgcgcccgctccggtggctgaccgtggtgctgacggccgccacggcggtcctgctcaccacggccggccccgccgcggcgcacgccggcgggctggtcgccaccgacgcccgcagccgggtggtgaccgtcacaccggcggtcccgggactcaccgtgaccgccatcgaggacggcgccagactgcgcctgacaaatcggacacccgggccggtcacggtcaccggccgccccggggtcgtcgcccccggcgacactctcacctgggcagacccgagcttcaccccggagggcaaaaagatcgcttccggccgtacgcaggattggacgctgaccctggacgccggcggcaccgccgtgacggtcagcggcatcctgatcggcgaacgcccgccggacccgtggccctggtgggcgctcgctatcgtggcggccgtggccatccccgtgatcgcacgtcgcctccaccggggcgacctgctgctctgcgcggccggcacggtggcgatggccgcgtcgatcgggcacgtcgccgggtccaccctggcggtcgagtcggcgccgccgctgggcacctttctcagcgccgccgggatcaacctgctggcctggccgctcatcctcggcggggcggtgaccacactgcgcggccggccggccgggctgctcgcggtctgcgcgggcgcggcgctgaccgcggtcttcgtcttccccgacgtgaccgcgttccaccgggcagtgctgccgttcgccgggccggcggtggcggagcgggccctggtcgtgctcgcgctgggactgggcgcgggcgtcgcggtggccggagcgtcggtgctgagaacgttggcgcagcgggcggaggcggtggcatgagagtggtgaccgcgggtctgctgctggtggcggcggcgctcctgaccgtgccggcgatgctggcgatgcaggtgctggcctcggccggcagcctggtctcggtgggcgcgctgtcggcggcgttcgtgctggtggtggcctccggatcgatcgcgctgttcgtgcagctcgcgctgctcgcgctgacccggccggtggccgggtcgccggcgggtccggtcggtggggcgccggccgtcggatcgccgcccatcgcttcggcgtccgtcgctccgcggtcggtcgcttcggcgcccgccgacgccggctcgtcgtcctagctagctagcagcccgcgccgcaccgggtgagtgtggcgctcggcagccgggtgcggctcggcgtcaccgtcgacaccgccgcgcagatccatgtccacggatacaacctggagtaccaggtgcagcccggccagccgacgtgcatcgtgttcgtggcctcgcaggccgggctcttcgacgtcgaggcccacccggacacgctgctgctccagctcgaagtgcagtgaacccacccgcttccggcccggccccgctcgcccacggggtgggcagctcgtccgacctgccgctgccgctggacctggtgctgcaggccggggcggcgaccgtggtgctgtccttcctgatcgcggcggtgctctggacccggccccggctcggcggcggcacggtgcgcgccgtccggacggcgggctggctgccggtgctgcgcctggtcgtgctcctgctcgcggtctacctggtcggcgacgcgttggccgggccgggcgaggacgagaacccggcggcccgcgccctgttcgtctggctgtgggtcgggatcatcccggtcagcgtgatcttcgggccggtgtggcgggcggtgaacccgctgcggaccctcttccgcctgctgcggctgccgcgcgcgggactccggccgcgaccagcgtccggtgcctggccggcggccgggtggctgctggcgttcgtgtggttcgagctggtcgcgccgcaccggaccgagccggcggtgatcggcgggtgcctgctcggctacgggatcgtccagctcgggatggccgcggtgcggggcgaggagtggttcgggcgcggcgactgcttcgaggtgtactccgaactcgccgggcggctcagcccggtgcggtggcggcggccgctgaccgggctggccgccccgctgccggtgacgcgcgggctcgcggctttcgtggcggtgtggtgggggtcgacgatcttcgacagcgcctccgggtcaccggtctgggccggattcgtgcagcgggcggggcacggcgcggtcctggcgaccggggcgttgctgctggtgtgctcgggggtgctgctcgccgtacgcaggatcgccgggaagtgggacgtgacggcgtcgctgatcccgatcgcggtggggtacacgctggcgcactacctgtcgctgctgatcgtggagggcccgcgcgggttcctgcagttgatccaccagtgggggatgggcggcgggccggccgggaacgtggcgccgatcccgggggtgatcgccggcgcacaggtggcgttgatccttgccggacacgttctgggcgtgatcgtggcgcatgatgcggcgcaggtcgccggctcggtggcaccggtcgccgtgggctcgggtgctccggccggcgcccccggtggcgggtccgtcgtctccggtgggccggttgccgccggagccgtggccgggcgggcggcgctgggcacgctggcggacgagttcccgctggtgctgttcatgatcgggtgtacctgggcggggctgttcctgctgttcgtgcgctgaccgccgggctgccaagggatccccggaaggtgcggttccggtcacgattcgtacatctgatctaatcatgcggtaaggtgcggacatgagcgtcgatgtcggtgatgacgacgggtcgcaggttccgcccgcgctgaaacagctaacgccgaaacagcagcgcatcctcacggtgatccgggactcggtgcgggaccggggcttcccgcccaccgtccgggagatcggcgccgcggtcgggctggtctcgccgtcctcggtcgcgcaccacctcaaggtgctggagcggcacggcctgttgcgtcgccagccgaacggttcccgcgccgtcgacgtgcgcaccgcggacccggccgtcaccatcccggtgctcggcgacatcgccgccggcgtcccgatcctggccgagcagcacgtcctcgaccacctcaccgtctccgccggcatggtcggccacggcaccctgttcgccctgaacgtcaagggtgactcgatgatcgacgccgccatctgtgacggcgacgtggtcatcgtccgccagcagcccgtcgcggagaacggtgagatcgtcgccgccatgctcgacggcgaggccaccgtcaagaccttccagcggcgcaacggccacatcgagctgatcccgcagaacccgaactatgcggtcatccccggcgacgacgccaccatcctcggcaaggtcgtctcggtcatccgccgcctctgaccgtcaccgggacccggcggcccggctgccgccgtcctccgctgcgccccggagggccgcggcgaggtggtcgcgggtctccgcgtcgaaggcgaccaggcggatccgttcgaccgcggtgggcgtgccggtcagggtggcgacggcgatgcgggcggcctcgccgggagggcccgcgcggcgcgacggggggctggacgtaccctggcggctgtgaacccgctggacgctgtcgccgccgcgttctcggcctgggtcactccggatctgccgctctacggcctcgaccacgaccgggccgacttcgcgccctgagccgcccaccggccggctgtccgacccgggagtctccccgggccgggtggccgccgcatggtccggttccggttccgtcgcgaaacgaaagagcgcatgtccgcacttcgcaccctgctccgtgccccgcacgtccgccgtctcctcaccgccagccaggtcggccgcctgccgatggcgtccgccccgctggccctgctgctgttcgcccgggagtcgcacagcctcgcgctggccgggctggtcgtcggcgcctacaccgccgggatggcggtcagcgccccgattctggcgcggatcgtcgaccgctggcgccagccacccgtcctctggggctcggccctgctctccggggcgggcttcctgctggtcgccgccggtggccacgcgaccggggcgacgatggccggcgcgctgctcggcgggctcggcaccccgccgctggaagcctgcctgcgcgccctctggccggatctggtcgaggcggacgtggtggccgccgcatacaccctggacatcgcggtgcaggaggtcatctatgtgaccgggccgctggtcaccctgctggccgtggcggtcgccggtccgccggccgggctggtcgcggccgcgctgctgcaactcgccggggtggcgctgttcgcgtcgacgccggtggtccgcacctggcgcggggtggcggcggtccggcactgggccgggccgctgcgggtgggccggttcgtgctgatcctgctcggcgtcgtcggcgccggcgcggcgatcggcagccttccggtggcggtcaccgggtatgccgaggcggccgggaaccggtcgctgagcggctggctgctcgccgccgaggcggccggcgcgctcaccggcggcctgctgtacatgcgtgcccgcccgggcggccggtcccggctgccgctggtcaccgcgggtctggcggccggtttcctgccgctgctcctgatgcccggcccggcggcgatggcggtgctgctcgcggtggccgggctgtcgctgccgccggtactgaccgcggtgttcctgaccgccgaccggctgaccccggccggcaccgccgtcgaggcgttcgcctgggtgatcaccgctttcacggtgggcagcgcggccggtgcggcgatcaccgggccgctggtcggtgactccgtccggtacgggttcaccttcgccccgatcgccggcctgctcgccgtggcggcgatgtccgcggtcgcctacggcccgggcggtcgacgatccgccgaccacccctcgccgagcggccggggagggtgacgagcagccggtcggccccgccgagcggccggggagggtgacgagcaaccggccggctgtcgctgggcgtcccgggaggtgaccccggggcgccggtgacacgcccggtgcccgcggatcgccggtgacacgcccggtgcccacggatcgccggtccgccgcgatgtcggcgggccggcacggtgcgtgacgtccgtccggaatgtgggatgacccacgccgccggagcgatgccaaatgtctgacttacggcgtattgtgacgtgggagagcggaaaccgggcccccgcaccggtgcctcatgaggctgatgcggctaacgttccggtgtggctaagggatctctggcggtgcttgtcggcattctcgtgctcgcgttgcacgtcggtctcggcctgctcgccgcgcaccggctgtggaccggctccgacgacccgcaccagtggatgtatttctacggcaccggcggctgctgcatcgccccggtgaccggcgcggtcggggccttcctgacgaacaatccgcgcttcaaggcgatcggcatcggcatgatgaccggggtagcgctggccctgatcgccgccacggtcggctgggcgatcaacttcatcccctcctgggcctcatgaccggggaatcaggccgaccgtcctgatcgggaaaccgcccgccgcaaccgtcgggggctagcattggcagccggtggagccggcggattccccctgccccggggctcgcaccgggtgacacgcggccatgggtggtgggggaatgcttaccgatgagcacaccgttctgctgtccccgcccgacgtcggggatctggagctggagtacgtcaccgccgccctgcgctccggctggatcgccccggccggcccggacctggaccggttcgaggcggagatcgccgaccgggtgggtgtgccgcacgcggtggcgctcacctcgggcacggcggcgctgcacctggccctgctcgggctcggcgccggcccgggtgacgtggtcgtggtgccgacgctcaccttcgtggcgaccgcgaacgccgtcgcctacaccggtgcgaccccggtcttcgccgactgtgatccggacaccggcaacctcgatccggacctgctcgacgccctgctgaccgagctgcgcgccgagggcgcgcgggtacgggcggtgatgaccgtcgacctgttcggcagctgcgccgactacgaccggatcgggccgctgtgcgaccggctcggcatcccggtcgtcgaggacgccgcggaggcgctcggcgccacccgtgcggggcgggccgccgggtcgttcggccgggtggcggcgctgtccttcaacggcaacaaggtgctcaccacgtccgggggcggcatgctgctcaccgcggacggcgggctggccgagcgtgcccggcacctggccggacaggcccggttgccggtcacccactacgagcacgccgagatcggttacagctatcgtctgagcaacatcctggccgcactgggccgcgcccagctgcggcggctggacgagatggtggagcgccggcgcgccctgcacgacgcgtacgccaaaatcttctccgatgtcgacggcgtgaccctgcccgccgacgccgacccgggctcgaaccgctggttgaccagcatcgtcgtcgatccggagcgggccggctggcaggccgccgagctggctgcgcatctggcggcgcgccgggtggagacccggccggtgttcaagccgatgcatctgcagccgctgttcgccggcgcccgggccgcgctgaccggcgccgccgagcgtctgttccgcaacgggctgctgctgcccagcggctccgcgctccgtgacgaccaggtgcggcgggtgctcgacgagatcgccgactacatgggtgaccgccgatgaagccgcggccgccggggcgcggcaccgacaccgtccagcgcgcgatcgacgtcgtcgccgccggggccggcctggtcctgctctccccggtgatcaccgtggtcgccggcgcggtggcggccggcctgggccgtccggtgctgttccgccagcagcgcccgggcctgcacggccgcccgttcaccctggtcaagttccgcaccatgcgggacctcgacgagcggcgcggcctggtcaccgacgccgaccggctgaccgggctgggccgggcgctgcgcgccaccagcctggacgagctgcccacgctctggaacgtgctgcgcggcgagatgagcctggtcggcccgcggccgttgctcatgcagtacctcgaccggtacacgccggagcaggcccgccggcacgaggtgcggcccggcatcaccgggctcgcgcaggtgagcggccgtaacgcggtgagctgggaggagcggttcgcgatcgacgtctggtacgtggaccaccgctcgctcggcctgaacctgcggatcctggcccgcaccgtgcgcctgctgctgcgccgcaccggcatcaccgccccgggggaggccaccatgccgctgttcctgggtagcgaccgtgcctgagcccctcgtgatcgtcggctgcggcggtcacggccgggagatcttcggcgtggtggcggcggtcaacgacgcgggcggcggcccgtggaaggtgctgggtttcctcgacgacgccccgtcggaggcgaatctgcgcgccctggaccggctcgggtccggctggctcggcccggccgcgctgctcgccggggtcgacgcccacttcgtgatcgggatcggcgatccgcgggtccgggacggggtggccgccgcgctggagccgtccgggcggccggcggcccggctggtgcacccggcggcgaccgtgggcccggacaccggcctggccgagggggtggtgctgttcgccggggcccgggtcaccacgaacgtcaccctgggccggcacgtgcacctcaaccagaatgccacggtcggccacgactcggtgctggacgcctgcgtgcaggtgaatccgctggccgcggtctccggcgactgccggctcgggcgcgcggtgctgatcgggaccggcgcggtggtgctccagggccggtcggtgggtgaccgggcgaccgtcggggccggcgcctgtgtggtccgggacgtcgaatcgggccggatcgtcaagggtgtaccggcaggatgagggggtgcggatcacctatgtgcaccagtacttcaagacgcccgggatggccggcgggacccggtcgtacgagttcgcccggcggttggtcgaacacggacaccaggtgcacatggtcaccgccgacgcgtccggcggaccggcccgggtcaccaccgaggccgggatcgtcgtgcactggctgccggtgccgtacgacaacgcgatgtcgtaccgccgccggatcctcgccttcctctccttcgtcggccgggccacgctggtggccgcccggctcgaccacgagctggtcttcgcgacgagcacgccgttgacggtggcgattccgggcgtggtcgccgcgatgcgccgccgggtgccgatggtgttcgaggtccgggatctgtggccgcgggcgccgatcgcggtcggggcgctgcggtcgccggccgcccgctgggccgccggccggttggaagcctgggcctaccgccggtcggcgcacgtcatcgcgctctccgacgacatggcggacagcatccagcgccggttcccgcgggtgccggtcaccgtggtgccgaacggctccgaccgggcgctgttcagcggcccggccgcccggcgggccggtgcggcgctgcgccggagcctgccgtggctcggcgaccgcccgatggtgctgtacgccggcgccctcggcgtggtcaacggcgtggactacctggtccgggcggccgcccggctggccgtgctcgacccggaggtgcgggtggtgatcctcggcgacggccggatgcgggagtcgatccgccggctggccgccgagctgggggtgctggagcgcaccctgttcctgctgccgccggtcgccaagaccgaggtggtcgcctggttcgccgcctgtgacctggccaccggcctcaccctgaaccgtccggagctgggcagcgactcgtcgaacaagctgctcgacgcgctggccgcgggccgtccggtcgcggtgaaccacggcggctggatcaccggcctgctcacccgcaccggggccggtctggccctgccgccggacgacccggagggtgcggccaccgtgctggccggcttcctgcgggacccggcggcgggcgcggcggcgcgccgggcggcgagtgcgctggcccgggaccggttcgaccgcaacgtgctgttccgcgacttcgagcgggtgctgatcgaagcccgctacggtctcggcgccggccggaccgcggcgagtaccagcaggatccacatcagccgggcgtcgtagtagtcgccggagaacaggcaggtggccccgatgaagatgccgcagtaggccgcggtccgtgccgccaggccgcgttcggccaccggcaccgcgcggtacgcctgccacagcgccacccaggccacgatcagcagggtcatgcccaccacgccgccctcggccaggatcgacagcagcaggttgtgcgtgtacaggtcgaggcccagcccgctgaggctggggaagccgttgagcccggtgcccagcagcgggtggcgcaggaacagctggaaggccatccggaacagcacgtcgcggtcggacaggtagccctgcccgacggtggtctgcacgaaccgctgctgcacgaacccggcgatggccgggccgccggcgatcaccacgagcgcgccgaccacgccgagcagggcgagcggcttgccggcccggtcgaagtcgatccgcggccggatcgcgaccagcgcgagcacggcggtgaagccgagcgcgaccaggccgccgcgggagccggacgcgaccgcgccgaacaggaacatcggaatcggcaccagccagatcatccgttcgccgtgccgcaggtacaggaacagcgaggtgatcacgccgaggatcatcaggcggacgaagacgttgggcccgccgccgagcgccgcccaccgcccgttcgcctcccggcccagcccggccgccgcggccaggaagtagacccaggcggcgacgtggaagagggtcagcgtcgtggcggtcacccgatcgccgtcccaggcggccaggatgtagtagacgatcaccagcccggtcagcgcgaccaggtcgccgacgaccggcccggtgatcgccccgggcggcgtccacagcaccgagacgccctggtaggcgaccaacgccaggatgccgagcagcgcctggccaccctgggccggatgcggcccggcgtagttggcctccaggaccagactcaggagcaggatcaggaacagcggtacgcggacgtcgttggccaccggaatgtccaggccggcccgcgacagggtgaaccggccggccagcgccaccacgaaggcgatcagcacgaccagcccgggtcgcgcggtgcccggcgcggtcgtcaccgggccacccggacggcgtgcgccgagccgtcgcgccgcgtccagcccgagcgccgtcgccgccgcggccaggccgagcaccgcggcgtgcggcggggccagcacggccatcccggccgtggtgaccacgacctgcagggcgagacagccgagcaggagccggctcagcagccggggcgccagtgtcgtctccagggtgggccgggcggcgtagaacatcgccagcggaaccgcggccggcacaccgagccgcagcaccgggaccgccgcggtgaactcggcgccgaggaaccggtggatgaggaccggggccgccagcacgatcaccgccaccggtatcgccgcgagcaccccggcggcggtgggcagggcacgcagcagtcgtcgtacggccgcatcgtcctggccccggtcggtgaagtgccggctcaggcggggcatcaggaccggggtgagcatggcgaactgggcgcagaccagggcgacggccgaggtggtgaacccggcataaccggcctcggggcgcccgggcatcgccaccgcgaccgccagcgcgggcaccgtgtagaacgcgggcagcgccagctcgccgggcgtgcggcgggcgccgtaggagagcagcgtgcgcagggtcggctccggcccggtgaccggcgggaacctgccgcggacggccagcatgccaccggcggcggccagccccgcgccgacgccctggaccagcaggaagtcctcgatccgtgcggtgctgacgaaggcgatcagcgggatcaggccgaggcccaggccgtacacgaggttcgcaccggtcacctgacgggtgccgcgcagcgcggcgaacgcgatggtgcacaggcagttgccaccgagcaggaccgcgatcgcgaccaccgcggaccggccgccgggcagtcccagcagcccggcgatccccggaccggccgccaccgcgatcagtccggcgacggtgaccaggacggtctcggcgagcagcgcctgccggaccagccggcgtgtggtcgccgcggtgtgcggcaggtagcgctgcagccccagcgcgagcccgaacatcagcggcggctgcagggtgctcgccacgctccgggcgatctggtagaaggcgaacccgccgacgctgccccgccgggccaccaggtggaacagcgccagaccggtgcccagcacgaaccactggacggccaggctggtgacgtagtcacgcagcaccggccgcagacccggcccttcggtcatgcggccgcggcccgggggccgggcccaccgaggtaggagtcgtagcggggcaccgcgtccggccccttgcgggccaccatgttcagcacgcagcccagcagcgtcgcgttgaccgcgtgcagcgcccggaccgccgcggtgacctgggccgacgtggtccgacgggcgcgcaccaccagcagcgtgccgtccgcgcgggcggcgaccacggccgcgtcggtcaccggcagcagtggcgggcaatcgaagatcaccacatcgaatttcttgcgtacggcgtcgaccagctccgtcatcctcggcgagctgagcagctcactcgggttcggcggggtccgcccgctggccagcagccacaacccggcgccccacggctgcagcacctgctccagcgccgcggtcccgtccaggaccgtgctcagcccggccgagtcctcccggccgagcagcgcggccagccgggggtgccgcagctcggcgtcgaccaccaggacgcgctgtccggcctcggcgaacagcagggccagcccgcaggcggtggcggaccggccctccccgggcaccgcgctggtgaccgcgagcgtcttgaccgagccggccgccgccgcgcactgcacctgggtgcggacctcgcgcagcgcctcggtgcgggccgaggcgctcggcgagacgaacgggtgaccccggtccagcggcacccgggccagcaccggggcggaggccagcacctgcagcgcgtcggcggtgcgcacggtgtggtcggccgcctcccggcccaccgcgccgatcgcgccggtgaccattccggcgaccgcggccagcgcgaagttgttcgcccagtccggcgagaccgggccgtcgtccagggccgggccggagaccacggtgaccttgacggtggacggctcaccggccttgggacgctccaggtcctcgaccgcggtgtcgaaccgccgggtgagccgggtgagcagcagcatcgcccggttgcggtcccggtcctcgacgctgacctccatcatcaccgtgtccgccacggtcttcgcgctgatcgcgtcccggacgtccttgaggctgaggtcgatgcccgggctgccggccagcggggtggccacctcgtcgctggtcagcagtttggcgtaggtggacagccggctggcgttgaacatgctggccgggtagaggtcggaggcgccggcgatcggggtggagaagaagaacgtgacccgcgccgcgtacaccggggtggtgttgaggttgacgatcagggcgacgccgagcgcgaggacgaccgaggtcagcagcaaccaccagttgcgccgggcgacacggaggtattcgcgcaggcccacccccgtcaccctaaagtactttttcaggatttttccgctgttacgctccggccatgatgggcgcacggttctgggcgtaccggcgcgtgttccccctactcgtcgacgccaccgcctgggccgtcggcctgttggccgcggtcctggcccggcacgacttcctgcccacccggcgccaccttgccgggggcctggccgcggtcggcctcgcggtcctgctgcaggcggtcatcgggcacacccggcacctgtaccgggggcggtaccggttcgccgagttcgacgagatccggtccgtggtgttcaccaccgcggcggtcaccgtggtgctcaccgtgatcgtggtgttcgtctggcatccggtctcgcccgggctgcccgccctcggcggcgccgccgcgctgaccctgatgctcggcatccgcgacctgcgccggctgcggtggtcccggcaacggcgcccggacgcgcagaccgccgcaccggttctgctgttcggggccggcaccgccggggcgatgctggtcgcctcgatgctgcacgaccggcacggccgctacctgccgaccgggctgatcgacgacgaccgggacaagcgccggctgcggatcctcggcgtgccggtgctgggcacccgcgacgacatcccgcgggcgctcgccgacaccggcgccggcctgctcatcttcgcggtcgccaacgccgacgccgccctggtccgcgacatccgcgaccggaccctggcggccggcgccgcgttccaggtggtgccgtcggtcagcgagatgatggaccagccggtcgaggtcggcgacatccgcgaggtgcaggtcgccgacctgctgggccggcatcagatcgacaccgacctgtccgggatcggcggctacctgaccggcaagcgggtcctggtcaccggtgccggcggctcgatcggctccgagctgtgccggcagatccaccggttccggccggccgagctgatgatgctggaccgcgacgagacgtcgctgctcgcggtgcagctctcgatcgacccggtggcgctgctcgacgacccgtcggtgatcctcgccgacctgcgtgacgccgaccgggtccgcgaggtgttccgcacccggcgtccgcaggtggtcttccacgcggccgcgctcaaacacctggcgctgctgcagcgctatcccgccgaggcgatcaagacgaacgtgctgggcaccctgaacgtgctggacgcggcgacgtcggtggagcggttcgtgaacatctccaccgacaaggcggccgacccgaccagcgtgctcggttactccaagcggatcaccgagcggctcaccgcgtggaccgcgcggcgtcgcaccggcaccttcctcagcgtccggttcggcaacgtgctgggcagccgcggctcggtgttcaccaagttcaacgcgcagatcgcgggcggtggcccgctcaccgtgacgcaccccgaggtgacccggtacttcatgaccattcaggaggcggtgcacctggtgatccaggccgccgcgatcgggcaggacggcgaggcgctggtcctggagatgggcgagccggtgcggatcgccgaggtggccgcccagatggcgcagttcgcgccggcgccggtggcgatcgagtacatcgggctgcggcccggcgagaagatctccgagacgctgttcggggccggcgaggtggacagccggccggaccatccgctgatctcgcacgtgcaggtgccgccgctggacccggtgcggctggcggcgctcgccgagccgtccgactccggcgtgctgatcgcccgcctggcggagatctgcgccgcacccgcgccggcaacggttgttcggtaagaatcgggttttccagcgcgaaagctattcgcactggtgcaatcggggcatggactcctcttcgcagagcgggccgcggcccgcgcgcgccggcgtgcacgcggcgctgcgggcctggcgggagagcctgatcgacctcggtgaccacaaccggctgatcaacttcgcggccggcaacgccgacctgctggagatcacctcgcccgacccgcatcaggtggtcaccacgctcagccggggcaccggggcggtgctgaccggttccggcggcgccgcgcccggcgacggcaccttccgcaccgagctgaccgaacgctcgctcggcccgctgctgcgccggctgcagcgccgtgcccggcaggaatacctggaccgcggcgtgttcgtgctgcacctggcgctcggcatgctgcactggcggctggccgccgacgacgaggacccggacagcgagaccaccagctacaccagcccgctgctgctgctcccggccgacctggtcaccggcgacctggccgagcagcccgagctgcggctgcgcgacgaggagccggtggtcaacccggcgctcgcgctgcggctgcgacgggccgggatcgccgtccccgacctggaaccggccgccgaactcaacgtgtcccggttctgggacgagttcaccggcacggtggcccggcggcacggctggcacatcgagcggaccgtcatcctcacctgcctcaccttccacaaggatgcgatctaccgcgacctgcgcgacaacgaggagcggatcctggcccacccggtggtccgggcgctggccaccaccgacccgcggcggcagaccgaagccttcaagttcaccccgatccggcccgaggaggtggaccggctcgccccgcccgagggcatgccgctggtcctggacgccgactcgtcccagcgtgcctgcgtggccgccgccctggccgggcacagcttcgtgatggacggcccgcccggcaccggcaagtcgcagaccgtggccaacatgatcggcgcgctgctgcacgccgggaaacgggtgctgttcgtctccgagaaggtggccgcgctcgacgtggtccgcaaccggctcgccgcggccgggctggaccgctacatcctggaactgcacggccagcaggccggccggcgcgaggtggccacgctgctggccgcggcggtcgacgagacgccggagccgcccgcggacgcccccgtgctcgaccgggccgcgctgcgcgaacgccgggaggcgctgaccgcctacgcggccgcgatgaacgagacccgccggccgctcggcgccagcctgtacgagatcatcggccgctgcgccgggctagctagctagggccgccgcggccgaggccgccacggcggtccagcagcgggccggcgtgccgtggaccgcgctgccgtccgccgccgacctgccgatgcccccgtcgttggaggcgtttcccggcccggtcggcctggacacgctgaccgcggccgacgccgacgaactcgcccgcgacttcgccagggccgccgaccaggtggaccggcaccgccgcgcggtcaaccgggtgaccgccaagctggggctgccgcaggccggcacgatccgcgacatcgcccgggtggcggcggtcgccgaactcggcgcccggccgcacaaaccggagcggttctggttcaccccgggcgcgctggccggcgtgcagaccggggcgggtgcgctgcgccgggccctggaggtgttggtcgccaccgagatccaggcccggccgtacttctccgaggcgatcctcgcgcagccggtcgaggagctggccgagcggttcgccacggtgcaccggggattcgggcggctgcgcgcggcgtaccgccgcgaccgccgccaggtggccggtttcgtgctgcccacggcgcacctcggcgacgccgtcgaccggatcggcaccgcggtcgcctggaaacgggcccggcaggagctggcggcggccgagcacgcgtacgccaccgccctcggccggtactggcagggccgcggcaccgacttcgtggccctcgacgaggcgatcgcggtggccgccgcggccctcgccgccgcaccaccggccggcatcggatcggtgctcacctacatctgcgcgccggcgcccgacccggagccgatccaggtggtcaccgaggcccgtgacgcactgctgcggtggcaggcgacgctgcggccggcgccctacccggcggcccgcccggagctggtgtccgggccgatcgacgacgcgatcgcctggctgaccgggcacgtgacggcgctgcacgcggtcgccgagacggtccgggcgtacgacgcggcgaccgggcacaccctcgactacgccgagacggtgcgactggggtcgctccgggacgcggcggcccgggcggcggcggccctcggcgggccggccgacgggctcgccgaggtcgatccgggtgccctcgccgcaaccgtggcatgggcggcgcaggcccgggacttcgccggcggtccgctctccgaggcgcagctcgtcgcgctgcgcgacctgcggccgatcgtcgggctggccgagcgggccgccgaatgggagcaggcgagccgggcggtgctcgccggcttcggcccctcccggcaggccgacctgcgcgaccggttcgccgactatcagcgggccgccgccttcctgcgcgacatccgcaacgacagcagcggccaggaggagtggttcgcctgcctggacgcccgtgacgtgctcaccttccacggcctggacgcggccgtcgaattctgcgccgaccggcgcctggacggcacggacgtgcccgcggtgctggaccgggcgctgctgcacggctgggccgacgcggtggtccgggccgaccatcggctgcggccgtggcgctccgacgaccgggaccggctggtcgccgaattccggcaggccgacgagcggctcgcggtggtcgcggcccgcgagatcgtcgcggcggtcgaggaccgccggccgccgcccgagagcgcggccgcgggcctgttgcggcgcgaggcgatgaaggccgatcggcaattgccggtacgtgacctgctgggccgtgcccgcgaagcggtcctggcgctgcgcccgtgtgtcctcgcgtccccgctcacggtgagccagtcgctgcccccggacatcggcttcgacgcggtcatcttcgacgaggcctcgcagatcaccccggccgacgcgatcaactgcatctaccgcggcacgtccctgatcaccgcgggcgacgaccgccagctgccgcccacctcgttcttcgatcgggcggccaccgaggtgccggacaccgaggtgctcgactaccagtccgtgctggagctggccaaggcctgcggagccttccccgggatgggtctgacctggcattaccgcagccggcaccaggcgctggtggcgttcgccaacgacgccttctaccagggccggctgagcaccttcccggccccgggcagtggcggcccggacaccggcgtcgccctcttcccggtcgccggggtgtaccggcgcagcaccggccgggacaacccggtcgaggcggaacgggtcgccgaacggatcgtgcaccacttcgccacccggccggaactctcggtgggcgtggtgaccttctcggtggcgcaggccgaggcgatcgaacgggccctggagaagctggcggccgggcagccggcgctggaacggatggtcaccgacgaccggctgcacggcttcttcatcaagagcctggagtcggtgcagggcgacgaacgcgacgtgatgatcttctcgatcggctacggctacgacgaggccggccggatcagcgcgaacttcggcgcgttgaaccggcccaacggctggcgccggctcaacgtggcgatcacccgggcccggcaccgggtggagatcgtcacctcgatcctgtcccgcgacgtgcccgagtcggagaacgagggcgtccggcagctggccgcctatctcgactacgtggagcgcggtgccggcgacaccagcctcgaccacaacgacccgaccggcgacttcgtcgaatcgatcctggagacggtccgcggctggggctatccggcccgggccgcgctgggcaccgcgggcggccgggtcgacatcgcgatccggcaccccgacgacccgtccgggcactacctgctcggcgtgcgctgcgacggccccggataccgggactgcccggccgcccgggaccgcgaccggctcaccgaccaggtgctgctcagtctcggctggcggctgcaccgggcgtgggcgctgtcctggtaccgcgaccgcgacggcgagcaggcccggctgcgggcggcgctggacgcggcccgggccgcctgggccgggcgcactagctagctagggtcgaaccacccgccgggcgggcgccggccacccgtgccggagtgccacggcgcgaccgggtacaacgcgcgcggacgtagacgtaccgctcgatgttgcttcttcggcatttttgagatccaccgcactgcggtgctccgtgacgggctcggccttcgtcttgaaccacaggacgagggctgagctttccgggggtgccgcatgccatcgacgtcagcgcgggagcggctgcgcgcggtgctcggctgggtgcgccggcgtccacggtggctgcgccgcaccgtcgccgcgctggtcgcggtcaacgtggtgctggtgctggccgccgccggatatgtgtggagcgtcgacctgccggccgacccggccccgccgcaggcctcggtgctctactaccgcgacgggcagaccgtgctggcccggatcgggctggccgaccgcaccgacgtcccgctcgaccgggtgccggtcggcgtgcgtcaggcgttcctggccgccgaggaccgcggcttctacgaccaccacggcgtctcggtgcgcggcctgttgcgcgcgctgtggtccaacgtggcgaaggacagcgggcagggcgcgtccaccatcacccagcagttcgcccgcaacgcgtacctgacccaggagcgcacggtcagccgcaaggccaaggaggcggcgctcgccctcaagctggaacaccggttcaccaaggaccagatcctcgagcgctacctgaacaccatctacttcggccgcggggcgtacggggtggaggccgccgcccaggccttcttcggctcgtcggtggaccggctcaccgcgtaccagggtgccgtgctggccgccatggtcaaggacccgacccgtggcgacccggccgtcgacccgcactggacgctgaaccggtggaaatggatcgtccgcgcgatgagcgacgccggctggctgccgcccggggcggccgaccggacgccgtaccccgcggtcgcccccgaatcggtgaccgccagcgcggtcggcggcccggtcgggctgatcgccgaccgggtcgaggacgaactcgtcgccgcgggggtcagccggcagcagatccgcaccggcggactgcgggtcatcacgaccatcgacccgcaggcgcagcgggcggcgaccgcgagcatcggcgccgcgctggccgggcagccggccgagctgcgcaccgcgctggtcgcgatcgatccgcacgacggcggggtgcgcgcctactacggcggcgaccgggggcgcggctactacgacgacgcgttggccgcccgcccgccggcgtcgaccttcaaaccgctggtgctggccgccgccgaggaacgcgacatcagctaccggtcgtactacaacgggacgtcgccgcggctgttctccgaccgcggcggggcgcccctctacaacctggacaacctgcagtgcccggtctgcccgctggacaccgcgatggtctactcgctgaacacgccgttctacgccctggccgagcagatcggcccgggccgggtgcgtgacctggcgctgcggctcggcgtgcccgcctcctacggcgaccagaccaccctggtcgatctcaacggcgaactcacccccggccgcacccgcgccgacatcgcgatcgggcgctatccggtcgcccccgccgacctggccggcgtctacgccaccctggccggcggcggcatccgcgccgaccggcacttcgtcacccgggtcgtcaccgcccagggcacggtcctgcaccgcgcggacaccaccggccgccgggtgctgggcgccgaggtggccgccgacgtcggcgcggtgctcacccgggtggtccagcacgacggcgcggtgcccggggtggcggccgccgcgaaaaccggctcccagcagtacggcaacacgtccgactcgtccgacgcgtggaccgccgggtgggccagcggactcgccgcggtggtctgggtgggacgcgacaagccggggccgatccgcacccgcaagggcgcggccatcaacggggacggcatgccgtacaccatcttcaagaccttcctggccggagcgctgcgcggcggccagcggatgtccctgccccccgcggccgaggtcgggcacgtcgagaaggccgacctgcagacgatcgagaccaaggtgtcgatgatccccggccgggtcttcgccgggccgcggcgcggcgaccaggtcgaccgctcgctggccgtcggcgactggagcgaacgcaccgcccggctcaccgcggcgctggaccggtacgccgcgaccgcccccgacttcgcggtgtccctcgtcgaccgcaggaccgggcggcacttcgactaccacggcgaccgtgcgtacgagacggccagcgtggtgaaagtggaactgctcgccgcccttctgctgtccgcccaggacgcccaccggcaactccgggccgcggaacgccgccgcgccgaaaaaatgatcaaagcgagcgacaacgacaccgccaagcaggtgtacgacgcgatcggcggcccgaccggcctgagcgccgccctcacccggctcgggctgaactccaccacaccgaaccccagcttcggcctgagccgcaccacagccctcgaccagacccggatgatcaccgccctcagcgactccggcggccccctggacagcacctcgaagcagcagatcctcaccctgatggcgaacgtcaacgccgaccagaactggggaatcagcgccgcctccttcgacggcgaacaggtcgcgctgaaaaacggctggctgtcccgcaccaccgaatcccaccgctggatcatcaacagcaccggccggatcaccggcgccaaaaccgacgtggccctgtccatcctctcccacggccacagcaaccagcccgacggaatcagcgtggtcgaacacatcgccgccctgacccgcagctacctaggctggtgaccacgacaccccagaacattcatccccgccggcagctctttcacaccccgctttcgtgatggctgatacccccaaagaaacgcgcagccgtcctgacgcagcccccaaatccccgcaacacaccctccgaaagacggcacagccagccccaaaaaagcccaccctccaaagaatggccccgatccaagataaagccgcggcacctcgactccacggcactccacatctcaataaaactgaaactgcgacaggtcaattccagcgcaatacccatatttttccaccccggccacagcccggtgaccacgacgcccccggagtaatcccacccgcccgagtgtcaccttgaccaccaccacaccccagcccccaaaacaattaaaagcccaccgtgtgccccatcaaccgcaggcggcgcgccagcagaaatcggcgcgccagccgccacctcctccgcgaccgtcgagcaggtgaggaccgtcgggtcggtcgcgaggtcgtcctcggctgtcgggttgggcgtgaggtcgtcttcggtcgcgaggtcgtcctcggctgtcgggttgggcgtgaggtcgtcttcggcggtcggggtggtggcggctgtcgggttgggcgtgaggtcgtcctcgaccgccgcagcggtgggcttgagggaggaggcaggcgtcggaaccgcatcgactggctgcggtcggtcggcagttcgctgccgccgtcgttcatcgccggcggtgaccgccgcccacgcgtcagcggcactccacccgttccgcaccagcttccgcgtatgcctttgtcgcagaccccatgcgcgatgccgagcatgctctcgccggaattcctctttctcctcggagtaattccgcgcagcagtgcgatcccgcatccgcgcgacctctggccgactgaacaaagacaactgccccacccccaaattatcccgccctccagggaaaaagtgtaagccccgtcaagtgccaaaaattattccttcggagccgtgcgggaaggtggtccgagagctaatgtggtgcacgcgggaatgttttgtctccggcgcccacaatctgaagtttcagtccacgctgcgagccgctctttcctcagggacgtgccagaaactcgaacatcgagagcaggtgatgtcttggtaatattttaaatacggtcacatctgttgccgggattcggctgcagcgggaagcctgccgacagcggtccgccactcctggcttcgggctcccggttgggacgcatcggtacggtgactacatggccgcatccggtttcgaccggcggtctgcggcacagctgccgatcgcggccgagcgcaccatctgggccagcggagtcccgcggctcgcgcgacctctgttccggctcgacgcggtgatcgacgccgctgacctcgccccggtcctggagtcggtgcggacgcacatcgtcgcctgacgctgctcggccaatgctggtggtggcaagccaggagcggtgtctgtgccgatgcctggtgctcctgctggtagctggtttgtggtgccggtaggtggtgccggtaggtggtctggtgtcggcgtgtgctggtggccggtggcggcaggagctctggtgctggcgtgtgctggtggctggtggcggcaggagctctggtgctggcgtgtgctggtggctggtggctggtttgtggtgccggtaggtggtctggtgtcggcgtgtgttggtggctggtggcggcaggagctctggtgttggcatgtgctggtagccggtgcgggtgcttgcggggcgtgagtgtgggcgtgttgtggtggaggatgtcggcatggacgagattctccgcagatcggacgcctcggcggcggtcggcgagttgggctggcggtttgtgctcggcacgttgcaggccgctgtcgcggtcgactcgatcagtgagggtgcgcaggtgctcgcccgggccgtcgcggcctgtggtgcggacgccgatgcgcacctccgggccgatctgtgcccgagccgggtcgtgttgagcctgcagtcggctgagcgggccgcggtgaccacccgcgacgccgaccttgccgggcggatcacgcgggccgtcggcgagggcggatggcggaccgggccggatctcggtgctgacgggccgcggtccgtgcagctgatcgagatcggcatcgacgcgttggacatcgcggccatccgtccgttctggcgggccgtgctcggctacaccgatgagccggggcacggtgacccggaggatcccgtcgtcgacccgctccggatcgggccggcgatctggttccagcagatggaccagccgcgtccgcagcgcaaccggatccacttcgacgtgagcgtgccgcacgacgaggcgcccgggcgcatcgaggccgcgctcgccgccggcggccggctcgtgtcgtcggagcatgcgccggccttctgggtgctggccgacgccgagggcaacgaggcctgcgtgaccacctggcagggccgtgactagagaccggaaatccggcagtagcgcgatcggtgccgtgtggtgatccggcaggggcgcgatcaccgtcgtgcgtgccgacctgacgggacggcagacagtactctggtgccctcaccgtgaggaggtgcggaatgcgaagccgtcgatccagcctggttttcggctgtctctgcgctgccctggccgcgtcggcgatggccgttcacctgccgtactacgcgatctttgccacggccgcgtttgtcgccgtcctgaccgtgtgggtggtcgttctgtcccgatccgggcgtcgccgctgagcgcgtcgagtggctgctgccggcggtagtcgcggagagggcggcttcggcgcggggctgaatgtcgccgaccgtgcggtgctccgtgcggggcagtggcgccaacgccggccgccggggtgtgcggtctcgcctgttgctgggtgccggggcagtggtggcagaggtcggcgcccggggtgtgcggtcttgcctgttgctgggtgccggggcagtggcggcaaaggtcggcgcccgggagcggtgccggggagagcccgccgggatggcgggccaccgcgccgggatggcgggctaccggtccaggcgatgggcggggtcagcgagaggcgccggggcctcggtcaggggcccgggtgggtggcggcgccgcgcaggagggcgtcgaccagggcggcggggaagttctcctcggggaggccggtggcggagccgaacatgctctgcatcatcgacgggccggagagcatcaggacggtgaggtcgatgttcaggtcggggcggagttcgccggtggcgatgccgcggcgcaggatgtcgcgcatgaattcgcggcggggttccatgaccgcgtggtgcatgcggttgagctccgggtcgcgttgcagctcggggagcaggcaggcggtgaccatgccgaactcgcgggcgcgggtggagcggttcgcggtgaccagggcgaccaggtcgtcgcgggcggagacaccgaccagcgtggggagcgggcctttcatgctgcgcaccgcgtcgatcaggagcgcctccttgttcggccaccggcggtagatggtggctttgccgacgccggctttggcggcgacctgctcgatggagacggaggcggcgctctgcccgtcggccagcagggcgagcaccgcgtcgaggatggcctcgtcggcctgggcgttgcggggccggccctagctagctagaggagccttgcgctcctggccggccgacgtggtgctggtcatggggttcattgttaccgacgggttacgcctcgaccagggctacgccctgctcctcggcgaggaccgggctgtgcgggccggccgggcgcttgccgggcaggaacagcgcggcgaccagggcgccgagcagggcgaagatcaggccgccggcggtggcccagtgcatcgcggtgacgaacgactcgttggcggtgtggatcagggcggggccggccggtccggcctgcgcggccaccgcgtacgccccggtgatcgattcgcgggccgcgtcggccgccgggccgggcaggccgtcggtggccgagcccaggttgtcgcggtagaccgaggagagcaccgcgccgaggaccgcgacgcccagcgcaccgccgagctggcggatggtgttgctgaccgcggagccgacgccggctttctcccgggggagcgccgacatgatcgactcggtggccggcggcatcacgttggccatgccgacgccctggacgaagaaggcgagggcgaccagcgcgatcggcgtggtcgcggtgatcggcagccagatggccagaccgagcgcgaccagcagcaggccgacggtgctgaccagtttcgggccgaaccgcttcaccatcgtggagctgatcggcgcgaagaccatctggccgaccgcgaacgggacgaacagcgcgccggactccagcgggccgtagccgcggaccagctgcaggtagaacgcgccgaagaacatcgcgcccatggcggcgaagaagaccagaccgatcatgccggtggaggcggagaactgccggttgcggaacagtcgcacgtccagcgacgggaattcgatccggctctggtagagcacgaagccggccagcaccagcacgccggaggcgagcggcgcccaggacagggtgtcgccgaagccgtcctcgccgcccttgatcacaccgtaggtgagcagggtcaggccgacgatcgagagcaggacgccgagcacgtcgacccggttgggccgggggtcgcgcgactcgggcaccagcacggtcaccagcaccacgccgatcaccacgatcggcacgttgatcaggaagaccgagccccaccagaagtgctccagcaggaagccgcccaggatcgggcccagggcgacggccagaccgaccgcgccggcccagacgccgatcgcccggccgcgctcgcgcggctcgaagacgttggcgatgatcgacagggtggacggcatgaccgcggccgcgcccaggcccatcaccgcgcgggcggcgatcagctggtcggggctgtcggcgtaggccgagatcagcgacgcgatgccgaacagcaccaggccgatggtcagggtgatccggcggcccaggcggtcggccaggatgccggcggtgaagagcaggcccgcgaagaccagcgtgtacgagttgatggcccactcgagctcgctctgcgtggcgccgaggccgcgctgcgggtccgcgatgatgcgcagggccacgttcagcacggtgttgtccagaaccaccacgagcaggctgatcaccagcacgcccaggatggcccagcgtcggggatgcccggcctggggttgtgctacgtcgttcatccggtgtttccccccggtttcgaaacggaactgtctcgtatctcaatagggacagtagccctgtccgcccgtgaaacggaacggtctcgtatcgaaagtgtcgcccgtcacgtgttggcctggagcgcgctgcagcttctggcgtcgccggcatggagcagtgggaccacctgggagcgcaccgggatctagccgacctgctgccggccctcgacgtcgagctcgacgccgaccagatcgcccggccggacgccgccggagcctgacggcgagagctcaccgccgccggagcccagctcgaccgagactcggggggacgcggacgccatctccaggatgccgtccgcatcgaccggtcgggccagcaggtaaccctgcgcgtactcgcaccccaggcgggcgagcacctgcaggtcggcggcgttgtccacgccctcggcgacggtcaccatgccgagggcgtgggccatccgcaccatggcgtcggcgagcgaggcgcgcgcctggtcgcggtggatgccggccacgaaggttcggtcgatcttgacgacgtcccagccgtggtcggcgacccgggccatcgaggagtacccggtgccgaagtcgtcgacggcgatcttgacgccggcccggcgcagcggcccgagcgcggcctcgaccgtctccggttcggccatcccggtctcggtcagttccagggtgagctggccgggcggcgtgccggtgcgctccagcgcggccagcacctggccggcgatggcggcgtcgagctgtcgcggggacaggttcaccgcgatcggaatccacccgccggtccggttgtaccagcctcgctgctcggtcagagcctgctccaggaccaccgtgaacacctgcccgacggtgccggccgcctcggcgatcgggatgaacaccaccggcggcagcgtgccgtcggccgggtgcgcccagcggaccagcgcctccaccgagtgcagccggccgtcgtcgacccggaagaccggctggtagacgcagtacagctcgcccgggtgggtgagtgcgcggcgcaggtcggcgtcgaggcgcaggcgctgggcggcctccgagcggacgtccgcgtcgaagcgcaccatccggccccggccggccgccttggcctggtacatcgcggtgtccgcgtcctgcatcagggtgtccgggtcggcgtcggtgtcggcggtggtgcgcagcccgatcgacagtgacgcgaagaattcggtgccgtcggccagtcgcatcggccggcccaggttgtcggcgaccccgccggcgatcacgtcggcctgctcctcggtggtgtccggcatcaggatgacgaattcgtcgccgccgagccggcacaccacgtcggtctcccggaccgccgcgcgcagccgggtgctgatctcgatcagcagctggtcgccggcgtcgtggccgaggctgtcgttgacgtccttgaagtggtccaggtcgcagaagagcaggccgacccgggcggcgggatcggccggcagggtgtccagcgccagcgccagccggtccatcagcaggctgcggttgaccagcccggtcagcgggtcgtgcccggcccgccaggccagctcgtggatcgggccggccagccggaccgcgaccaaagccatggacagcgcggcgccgagcaccaggggtgcgtccgagccgggctcccagaacaggtgcaggcagggcagcagcagggccgcgccgaacaggatcagcgctcggttcagggtcagggtggtcatcgcggcgcggcgcggcgtggtgttcaccatcgacgggtgcagcgcggcggtgccgagcaggatcggcatcgccatccagcccaggtcgatcagcccgccctcgcggtacgtcccggccaggctctggtgggtgtagagggcgtcggagacgaaccaggcgaccagtccggtcagcagccagcgcaccccgggtgtgcgcagctcgacgccgagcgccagggccagcgcgcagtacaccacgatcagcgtgttgaccggcgcggacgcggcgaagaaccgggcggtcaggctgccgccgacggtgaccgtcggttcgaccaccaggatccaggcgaggctggccagcggggacagcagcaccgcggcgtcgatgaaggcggtccggccggcccgggcggccagcatcgccgtgccggccgcgatggtcaggtgcccgagcaggtacagccagtcggcgatcgacgggaaggccggttcgccgctgaccgcggtgtgcacggcgaagagcacgtcgccggcggccgagaacgccaggccgagcccgatcacccgccagccggcccggcgctgcggcaggttcccacgcagcccgagccaggtggccagcggtgccgtgctgttcaccaccacgtagatccaccgggtgtcggcgttgaacggggtgagcaggtagacggcggtcagcgcgccggtcgtcagcagatagatccaccacagatggcggatcccgcgggagtgcatgtgaggtcctatcggcgggcaccggtccgactggagacttctgcccggtccttccgatgctgccgtaccggagacgccggtgcgcgggtttcgcccagcgggggttctccatccgtggccgggtctcgcatcacccgacaccctcgtgaaaggttgaccggtatggatctcagcggcaaggtcaccggcttcgcgcttcctgacctcgagcactcggttcgggagaagatcctgctgcgcaacacggcccgatcgttcttcgaaggagatgtgtcatgaccacgatcgtcaacggactcgacgagctgaaggccctggtcggccgggacctgggggccagcgagtggctggagatcacccaggagcgggtgaacacgttcgccgacgcgacgggggaccaccagtggatccacgtggacgtcgaacgggcgaagggcgggccgttcggcgggccgatcgcgcacggctacctgaccctgtcgctggtgatcccgctgttcggctcgctgctcaaggtcgaggggatcacgatgggggtgaactacgggctggagagggtgcgtttcccgcacccggtgcgggtcgggtcgaagatccggctggcggcgaccgtggtgagcgtcgaggacgtgcccggggggacgcagagcacgttcgacttcaccgtgcagatcgatggggtggacaagccggcctgcgtggctcgtgcggtctatcggcagtacgcgtaaggggaccggggcatggccgggcgccgggcggctctgtcgcccggcgcaccgtgccggacttcggcgggtgccggtgacgtccgcccggcttacggccaggtggtgtcgaccagggtggggaggatctcggcggcggggccggggaggttgacagtggcgatcgggtcgaggggggtgggctgggggttgatctgcagcacggcggcgccggcccgggcggccaggcgggggatctcggcggcggggtagacgaggcccgaagtgccgatggtgagcaggacatcgcaggcggaggcggctcggacagcggactccagagcgtactcggggagtggctcgccgaaccagacgacgccgggtcggatcggcccggtgcagtgccggcagcggggcggggggatgcggcggccctcggcgtcggcgtcgtccgggatgggaggcgggagcggggccgggcgcgaacacgatgcgcagcgtggagtgaacaggctgccgtgcaggtgcaggggtgccggcgaaccggcgcgttcgtgcaggtcgtcgacgttctgggtgatgacggtgagccgcggcaggtgcgccgccatccgggagacggccaggtggccgtggttcgggcggacccgctggaccaggcggcggcgccactcgtaccagccccagaccaggtccggatcctcggcgaaagcctgcggggtggccagggcctgcgcatcgaaccgcgaccacaggccggtcagggcgtcgcggaaggtggggaccccgctctcggccgagatgccggcaccggtgaagaccaccacgtgcccggcccgggccaggagtttcgccgcctcgcccagggccatctcggtctgctcctccgccactgcccgccgcgcgggccgaaaacggcccgggttgcgggccgagtgaagtctcgcagcggcgcggccggggcgcatcaccgttcccgtggtgggtcgtttgaggaacagacgggtctggtggagggttcgatgcatcgaggacgaaacctctgggcggccggggttctggccgcgatgacagtcatgacgacggtggccggctgcggcgcggccacaccggaacgggacgccgggcgtccgctcacgcccgtgtcggacagcctgtcgccggggtccgggtcgccgccgcgccgggacgtgctggcgccggacgaactgccgcgcgatgtgctgccgggtgacgaactgccgcgcgatgtgctgccgggtgacgagccgccggccgatccgggtgccggcagtggtgcccggccgcggggccggcgggccggggacggcaaccggcggaccgggtcgaaagacgggtggggcgccgacccgccgggctggaccggctcgccgcggcggggtgtggacgctcggaccggcgatccggctttgatgccttcgcagccgtcgcccacggtgaccggaaatgcccaaccgccaccgtcggcgaagccgaagcggccgaagaagccgaagaagaccacgccggccaccggtccgaccgcccccaccgatcagaccgcggcggatccgcccgccgacgccggacagaccgagagttgcggcggctcggcgtgccggtgaccccggcccgcgccgccgcggactggcgtcggcgcctggacgcactcggcgcccgcacgatgaccgtggtcggtgactggatcgcgcccagcccccggcccggcccgtccgacgggcacgtcaaagccctggtcacggtcgtggcactggtcggcggggtggtcccgatcctggtcatggcactgacctgggcgatgcggcccaaggtcgaggaccaccatcgactgtgtacgaccccggccggtgaacgcctcggctacgtggtcgccgaccgccccgccgacgatcggtaccggccggcggcccagtgcaactcgaccggcgcggagaacgccgtgcggcgcaccgggatcgggcgctacgaggtcaccctcgccggcctgggcaccggcgggggagcggccgaggtgaccccggtaaccaccgatgaccggatctgcacactgctggactggtccgcggactcggcggacgagcggctgcgggtgggctgcttcgatcgggccggccgggcggcggacagcggattcaccgccgggttctggaccgcccgcggtagggcgcccgccgcctacctgcgcctgggcgacccgggccggaccagccagacggctcaggacgagtacagcttcaactcggcggacggactgaactcggcggaccgcggggacgtcggctcctacgtcgtgtcgttcggcggcctggacggtgtcgcgggcggtgcggtgaaggtgaccgcggtgggagacgcggcgacggtctgcgccgtcgaaggctggtcgggtgatcaggagaatcggtatctcgccgtccgcgtccactgccgggatgccgccgggcagccgatcgactcgcggttcgcggtgaccttcgcggtgggtcgccccacgacgggtgggtatgtgcgcgcggaccgtcccggacaggccgggtatgcggcgacgggggactatcagttcaacagcagcggcggggcgaacggggtgcggcgctcggggccgggcgactatcgggtgagtctcggcggggtggtcagctctgggggaagtgcgcaggtcacggcgtacggctcgaccgtcgactgcgtcacgacgccggcgggcgggaatccggatgtgcgtgtggtctgccgggatccgtccgggacaccgatcgacacggctttcgtcctgatctatacggcatgacgcgctggtcatggtgggtgcgggcggtcaggtcgccgggtgcaggagcaggtcggcgcagtgggccggtgcgtcggggaacggcaggtggccgcacccgggcaggggtacgtggcgggcggcgggcagcgccgtgcgggcgcgaagcgcctggttgcggtacggcaggacggcatcgcgggtgccccaggcgatggtgaccgggatggtcggcagcgcgccggggtcggtggcggcccacggggtgagccggcggaacgcggatcgggcggcggcgaacccgggggccgcggccagggcccgggcggcggccagcgactcgtcccggtcgagccggcccgggtgggcgtagaagatcgagcacagtgcggcccggccggccggggtggccatcaggcgggggagcagcgggtcgagggcggtggcgccggcccgggcggcggtgacgatgaagcggcaccagcggccgccgccggtgggccagaagccgatcggggagaacgcggtgaccgtgcgggcccggccgcggcggccgagttccagggcgatgccaccgcccatcgagctgccaccgacctcgacggtgtccaggccgagcgagtccagaaaagcctcgacctgatcggcgagatgccgcaccgagccgggcccgtccggggatgccggggcggggcgcggcaccgggcccggcaccgcggccgggggccacggcggcgaggcgccgaagccgggaaggtccacgctgatgacgtcgcggtgcgggctcagcaggggcagcaggggcagccagacctgccagtggctgcccagcccgtggatcagcagcagtggggccccggagccgcgacggtcatggatcatcggtgcaccatgccggcccgcggtccgcaaagataccgccgggcgggcggattcgcgcaggcagcaaggagcggaacccgttgttgacatgttgccaataagggcgtgatgctacggcgatgtcgttcgactacgacgtcctcatcatcgggtccgggttcggcggcagcgtgagcgcgctgcggctgaccgagaagggctaccgggtgggcgtcctcgaggccggtcgccggttcgccgacgagcagttcgccaagacgtcctggcggctgcgcgactatgtctacgcgccggccctcggctgttacgggatcctccggctgaccctgctcaagaacgtcctgatcatgtcgggcgccggcgtgggcggcggctcgctcggctatgcgaacacgctctacgagccgccggacgcgttcttcgccgacccgcagtgggcggcgatcaccgactggaagcgcgagctcgggccctactacgaccaggccaggcggatgctcggcgtgatcacgaacccggtggagaccgacgcggatcgggctttgcgagccgtggcggaggatctcggcgtcgggcacacctatcggcgtacccccgtgggcgtgtttttcggccgggacggcagcgaacccggcgccgaggcgccggacccgttcttcggcggcgccggaccggcccggcgcggctgcacactgtgcggctcgtgcatgaccgggtgccgcggcaacgccaagaacaccctggtcaaaaactatctgtacctggccgagcgggccggcgcgcgggtccacgagctgaccacggtgcgtaacgtgcggccgctgcccggcggtggctacgcggtcgccacccggcgcaccggcgggctgcggcggtccaccctcaccgcccggcaggtgatcttcgcggccggggcgctcggcacccagcggctgctgcaccggttgcgcgaccggggcagcctgcccgcggtctcgccgcggctcggcgagctgagccgcaccaactccgagtcgatcctgggcgcgcgcacccggcgccgggaccgcgactacagccacggcgtcgcgatcacctcgtcgatccacccggacccggtgacccatgtcgagccggtccgatacggcccgggcagcaacctgctcgcgctgctgtccaccgtgctggtcgacgacaccggccgcggcccgcgctggtgggccggcctgcggcaactcgccacggccgggcgcgacctgcgtctgtatctgtcgccgcgggactggtcgcggcagaccgtggtgctgctcgccatgcagccgctggacaattcgatcaccgtcttccgccgccggggacggctcaccagccgacccggggtgggcgagccgaaccccgcatgggttccggccgcgcacgaggtggcccgccggaccgcggaaaaggtggacggggtgccgctcgggtcgtataccgcatgggtgggcaagccggtgaccggtcatttcatcggcggctgcgcgatcggcgccgacccggagtccggcgtggtcgatccgtatcatcggctgttcgggcatcccggcctgcacgtgatcgacggatcggtggtggccgccaatctgggtgtcaacccgtcgctgacgatcaccgcgctggccgaacgcgcggtcgcgctgtggcccaacaacggcgaagaggacacccgcccgccgatcggtcacggttatctcggcatcggtccgacggcgccggtacgccccgccgtgccaccgtccgcacccggtgccctccgcttcccgggggtggcccgatgacccgcatcctcgtcatcggcgccggcttcggcggggtggccgcggcgaacgccctgctcaaagccgggttcaccgacatcaccctgatcgagaaggcggaccgtcccggcggggtgtggcgcgacaaccgctatcccggctgcgcgtgcgacatcccggcgccgctctactcgtactcgtacgccccgaatgcggcctggacccgccgcttcccgccgcagccggagatcctggactacctcgaacgctgcgtgtccgcattcggtctcaccggccgggtccggttcggcaccgaggtgagcgccgccgactggaccggctcggcctggcaggtgacgctcgcggacggcgagatcctggaggccgacgtgctgatcccggccgtcgggcagctgtcccggccggtcatccctcggctgcccggcacgttcggcgggcccgcgatgcacaccgctcgatgggacgcgtcggtgccgatcgagggccggcgggtcgccgtgatcggcaccggggccagcgtgatccagctcgtgccggccatcgcgggacgggccgcgcacgtcacggtcttccagcgcagcgccccgtggacgctgcccaaaccggaccggcgctacgggcggacccgccggaggctgtacgagatggcccccgtcctgatggcgccgtcccgcgccggaacgtggctgatgaccgtggtgaccgggcttgcggtgaccggcaaccgggccgccggcgcgctgctgcacgggctgtcccgggcccagcgccgttggcaggtacgcgacccggaactgcgccgcaaggtcaccccggacgagccgatgggctgcaaacgggtgctgttcaccaacgcctggtatccggcgctggcccgccccgacgtcgacctggtcaccgagaagatcgtcgaggtgaccgagaacggcatccgcaccgcggacggtgccgaccatccgtgcgacgtgatcgtctacggcaccggcttcgcggccaccgacttcctggtcccgatccgggtcaccggccgcgccgggacctcgctggacgaggcgtggcgggacggggcacacgcgtacctgggaatggccgttccgggatttcccaacatgttcctggtgtacggcccgaacacgaacaccgggaacacgtccgtggtcttcttccacgaggcccaggcccgctggatcgcgcaggccgtccggcggatcgcgcggagccggcaaccgctggaggtacgcccggaggtggccgccgcctacgacgaggaaatgcagggccggctcgccggaagtgtctgggcggcctgccagagctggtaccgcaccgcgtccggccgcatcgtgaccaactggcccggaatggccgccgaataccgccgccgcaccgcccgcctgaacccggccgacttccggtgaccggccgcgacggctcaccgccaccgcatgcccgggaccgcgtcgggcgtcgcgccgccgggcgccggccgtcccgccgtcgtggggctgaccggctgccggaccagccagcggggcccggcggtgcccggactcagcgcgcggtcgtggcggtgacgtaggtgtcgatctcggtgagcagggcggacctgcccgtggcgtcgaggaacgagtagcggaccgcctgccgggccaggtcggcgacgccgtgctcgtccaggccgagcaggtccgcggccacctgatactcgtggttgagggtggtggagaacatcggcgggtcgtcggagttgacggtgaccggcaccccggccgcgaccagtgccgggaggggatgctcggccagggacggcaccgaccgggtgcagacgttggaggtcgggcagacctccagggcgatgtcgtgctcgcgcaggtaggccatcagttccggatcgcgcgcggcggcgatgccgtggccgatgcgttccgcgccgaggtggtgcagcgcgtcccagacggtctgcgggccggtcgactcgccggcgtgcggcacgctgcgcagcccggcggcccgcgcggcggcgaaatggccggcgtaactctcccgggagatgccggcttccgggccgcccagcccgaagctgaccaggccgtccggccgctgccggagcgccacgtcgagggtcacgtcggcgccggtcatggtcggctcgccgggaatgtcgaaacaccagcgcagttccacgccgtggtcacgggcgacccgtcgccgggcgtcctccaccgcctcgcagtacgcctcggccgggatgccgcggaccaccgaggagtacggggtcagcgtcagctccgcgtaccgcaccgactgcccggccagaccggcgccgatgtcgtaggtgagcgtggccacgtcctcggcgtcgcggatcagatccacaaccgacagatacacctcgatgaaatgcgcgaagtcggtgaaggtgaagtactccgcgagcagggccgggtcggccggcaccgaggtgctcccggcgtgccgctcggccagacgcgccacggtccgcggtgtcgccgagccgacgtggtgcacgtgcagctccaccttgggcaggccggcgatgaatccggtcaggtccgatgccatgaatgcgtcccccacaggtcgtccgccgggggcacgcgtccagggcagcctccggcgggaggcgcccttgcgaccagggacaggccgagcgtggcggatgaaacatccgtcgcagcgcccctcgacccgcacccggacgctaacaaggcccgctctgcgcggcaatccgcccaccgggtccctccggaaacgaaaccggtgagcagcccgagccgagcgtgatgacgaggggcgacggcgccgcgcagacggatgagccgggtcagcggctggtggtgatctcggcggccgccgccgtctccgacggctcctccgggactttcgtacggcggagagccgcggccgcgaccagtagacagagacccgcaccgacgagcaccagacggtagtcgaggacggcgatgaggacggcgccgagggcgaggccggcggtctgcggcccggtgaactgcggtgcgcggtgcagaccctggctgatgacggcgtagccggtcgcatcgccgccgccgccgacggcgaaggccgcgaggacgctggcgagcgtcacgcgtcgcagcggcggacttccggagaggaatcggaagccggcaccgagctcggtggtgatccggcgcagggggtgcatggggatcgcccgtgctgcggcggcatcgacgggccggggctcggcgatccgggtccgccagtgatcaaggagcacctgatcgagcgcctacgccgcgggtgaatttcgggtcgtccccccgcacgtcgggtttcagaggaccgtgagcagaggccgggccgggaggagcgggaccgcgtcgggtggggtggggcggttgaggtggtagccctgcaacaggtcgacgccggcccgggccaggtcggccgcggtgggttcgtcctcgacgccctcggcgacgaccttcatgccgagggccttcgcgatggcgatcaccgagtcgatgatcgtggcgtgcgccggggagtcgtgcatctggacgacgaacgagcggtcgatcttcaattcgtcgatgggcaggcgggggagcaggcccagcgacgtgtagccggtgccgaagtcgtcgatggccacccggacgccgcgcaggcgcaggtcggccagctgggcggcgacctcgtcggggcgggccagcacggcggtctcggtgatctcgacggtgagcagttcggcggggagctgttcgaggtcgagcatggccaggatggtgggtacggcgcgggcctgggccaggtaggcggccggcaggttgaccgagacgggcacgtggtgaccggcccgtttccacagggcggcctggtgcagggcttcggccagcacccagtcggtgagttccaggatgacgtcggaacgttccgcgtcgggcaggaacacgcccgggggcagcaggccgcgctgcgggtgctgccagcggaccagggcctcgacgccgttgatctcgcgggtgacggcgtcgtgcagcggctggtagtgcaggcgcaggtggccgctcttcaggccggtgcgcagctcggtgagctggcgcaggtcgacacgctgggtggagtccaggccgggggtccaggagacgacgccggtgcggtcctgcttggcgcggcgcatggcggccgcggcgcggcgctggacgacctggatgtcgtggtggtcggcggggctgacgccgatgctgacctcgacgccgatcggcaggccgtcgacggtgtgcgggccgcgcagaccggccgcgatgtgccggcccatcgactgcggggtgtggccggccggcaggtcgccgagcagcaccaggaactggtcgccgtcgagacgggcggccaggtcgccggggccgtgcgcggcgctcagcgcgaccgccacccggtgcagcaggatgtcggcgccgtggtggcccagcacgtcgttggcgtcctggaaccggtccaggcccaggtgcagaacggcgaccagggtgccggcgtcgagacggcgctggccctcggcggcgatcaggctgcggttcggcaggccggtcagctggtcggtgcgggacagtttggcgtagcgaccggccatcgcggacagcagctccatcatcggggcgatgccgcagcggccgtccggccagacgaccaggaccggctcctcgcggtcgccgcccttgcgggccagggcggcctcggcggcgacgtcgatgtcggtgtcggcgggcagcgcgagcgagtccgcgccggccaggtcggccagggtgccgcgaaccgtgagggcccgcccgaaacccagccggccggtcgtcgtgcggttcagcgcgatccggctgaccaggcggtatccggtgtcggtggcgacgatgacgccgggcgtcagctgctcggcgtgcagcatcgcctcgacctcgctgatcggggtggcggccggcatcggcgcggtcggaatgccgatctcaccgagcttgcgcggcagccgcggagtggccgtcacgagcggccggcccgggagcggaggccgcggggcgggagcggactagctagctaggcgggccgcccgtcccgggccgccgcccagcaccgggccagttcgtcgtggtcggccgggtcgatcagcgcgacgaggtcggcgaccggcgcgccggcgtcggcggccgcggtgaacgacagcggggccagccggtgggtcaggtcctccagctcgtgccgggtgccggccaggcgcacctcggtggcgtgctcgcgggtctggtcgagcagcatgccgtcccagacggtggcgccgcccggctcccggtgcgggcgggcgacgccgtacagccaacggcgctgcccgtcgtgccggacgatcgcgccgcgccactcccacggctccagggtggccgccgactcgcggaccgaggcccggtacgactcgcggtgctcctcggcgatgtaggtgatcaggtcggcctcggtgccgccgacgatctgttccggcgccaggccgtagaggtcgcggcaggccgcggagacgaaggtgaacgcgcccgtgccgtccggctcgatccggaactggtacagcatgcccggcgcgttgttcaccgtgctgcggaaccgttcctcgccggcggccagtgcggcctcggtgcggcggcgggcggtgtcgtcgatggcgatcgtgcagacgccgtacaccgagccgtccgggtcggcgagcgggacccgggtcaccacgtactcccggatgtcgtcgccgaacggaagctgttccaggacggtccgggcggcgcccgagccggccacctcgacgtcgtgcgcgcggctgccggcggcgatcgcggcgggcagcacgtcggcctcctcgcggcccaccatgtcggcggccgacacctggaacacccgctcgtattcgccgttgacgaacaggtagcggccgtccaggtccttggccgagatcaccgcggtggtgtgctgcagaatcgcgttgatcagctggttgctgcgctgcagctcctgccgggcctggtgccattcggtctggtcggagatgaacgcgcagaagccgtccgggccgagcgagtccagggtcatcgacacggtcagctcggagccgtcccggtgcacggccggcgcctcgaatcggtggcccaggtcggggccgtcaccgagggcgagccggcgggcgaatccggcgttgtgcgcggaccgcagggccggcgggatgatggtgtcggcgagcggtcgcccgatcacctcgtcccggggccagccgaagaggcgttccgcggcttcgttccagtcctggatccggccggcccggtcgatgtgcaggtaggccagcgagcaggcgcccacggcccggttccggccgtcggccaccggctgctcggtgatctgcggggtcaacacccccgcatcatcgggccgccggtggccgacctgagtcttagctcaaccggaagacggtcccggtcttcgcggtgccgatcgcccccttgtcgacccgcaggaacagcgcggggtcggcggcggtgcggatcgtcacgccgccgcgggccgggatccggcgcaccggggtgccggccgggtcgagccggaccgaggtcccgtcgatgcggacggacagtgacggtttgtcgaccgaccggatggtctccgtgccgtcggcggcggcgacgaagcggaactgggtggcgcccaggtcctccggtgccggcgccatctccagggaggtcgtgccgtggtgcaggaagtcccggccggcggacagccgcacgatcggcccgccgtctcccaccggtacgccgaacagcggcgtcccgtccggatgccagtacagcttctgcaccctggtgtgccggttcgggtcgtacagcggatcgccgttgatctgtgggtagtcccgcgcgtggtagacgagcacgtcggtccggccgtcctcggccacggtgaagctgttgtgcccgggaccccaccgttgggtgtcgtcgtcgctggtgaagatcgggtcggggctcttcacccagctcgcccggtccagcaggttcgcgtgcgcgtccgcggtgagcagccccatgcagtagttggcgtcggtggcgctggccgagaaggtgaggaacacccgtccgttgcggaccagcacggccggcccctcgttcaccttgaagccctggatctcccaggtcttcgtcggcgtggtcagccgtaccggtttcgtccggagcgtccacgggttggccagctcggcgatgtagatgctggtgttgaccgcgatctccggctcgctctgcgcccacaccaggtactgccggccgcggtgggcgaaggtggtggcgtccagcgcgaagctgtcccactccagagcgatctcacccttgagcacccagccggacgggtcgagcgggtcggcgagcgacgactcgagcacccacggccggatgtgccagatgtcgtcggcggtgctcttggtgaagtagacgtaccacttgtcgtcgatgcggtgcagctccggagcccagatgaaaccgttgttcggctgggtccagatggtggtctcggtggcggtggtcaacccggccagggtcggcgagccgcgcagcaccaccctgtcgtacgccggcaccgagccggtgaagtagtacttcccgtcgtaccgccggctgatgaacgggtcggcccgctggctgatcagcggctgggcggtcggcacgccgtagatctcggcgtcgttgagcaccgggtcggcgtgcggcgcgccctcggcgccggcgggcaggacggtggtcagcgccccggcggcgccgcccagcagaagagtccggcgattcatgatgggtctcctcatcgggtccggatgcgcaggaaggtgaccgaatcggccgggaactcccgggtgaagctcgacgcgacaccgtggatggtgctggtcaccggctggatcggctcggcggtgcgggtattctgctcgcccgggtcaccggccaggacggtcatcctcgcggtgccggcgaccttgcggttgcccaggtcgatcctggtcagggccggcttgtcctgggcgttgaccaccttgacgatcagctcgccggtcttcgcgtcggtggtgacgacctgggcgaacggctcggtcaccgcgttgtcgtcgaagctgccccactcggcgccgtccaggtacagggtcaccctggtgccccggacggagactctcaggtcgtacgtctgaccggtcttgatcgtgttgggcctggtgagcagctgctccttggccgaggtgacccccttctcgaccgcgccctgggtgttgttccagccgcccaggttccaccagtagaagttgcccgtctgctggatgccgaaggcgaccaggaaaccctcggagccggtctgcttggtggccttgagcgtgtagtcgtagtcggtgtccgtgatggtcgccgccttgaccatggtgtcctcggtgtccgtggtggtctgtgcgtacccgccatcggtcaccgtccaggtgccgcgcggctgcaccgcggtccaaccgtcggcatcgccgtcgccgaagtcgtcgctgaagatcgtggtcccgtccgggcgggtgaccttcacgtcgtcgtacgtggcggcggtccgccaggtggacagcccgatcgctccggtgatcggcttcggccgcaccacaccgccaccggtgaccgtgctcggcaccacccggtcaccgacgttgttcatgaacagcttctgcatctgatagctggtcgaaccccacgactcgtcgttgtcgaaccagatcatgtccggtttccactgcacgttgtcaatgttggccagcagcggcgcgtaggacgccatcttcaccacgtcggcattgcgttccaggccggtcatgtaggccgcctcggcgagcgagttggcgaacctggcgtccagcgacgcgtattcaccgagaaaaaccttgggaccattacggtcgtacgagtcgtaccgcccgttgttctgcaggaaccaggatgggctgttgtagtagtgctcgtcgaccatgtccgtgtggttcgccctgttcttggcccacaggttctcgaacgtgccaccctggtcgtccggcccggaattgccgaccagcgtgatcgacgggtatttcgccttgatcgcggcctggaaccggaggaagttcgcgaagtactgctccggcagattctcctcgttgccgatcgcgatggtggtcagcccgaacggcttcgggtgccccatctgtgcccgcaccctgccccaggtcgagtccttcggcccgttggcgaactcgatcaggtcgagcgcgtcctggacgtgccgctgcagcagcgcgtcgtcgaccgtcgcccgattctgcccgcagccggtgaccagggccggcagcaccggcagcggcatcgccccgagatcctcggcgaactggaagtattcgtagtagcccaggccgtacgactggttgtagccccagaagttcttgttcgtggcgcgggtctcgaccgggccgaccgtgtccttccactggtacgcccgggcccgcgggtagttgttcgccgcgtcgtaggagtacatgctgccggtgttgaccaggcagccgccggggaagcggacgaagcccgggtgcagggcggcgatcttctcggcgaggtcgtcgcgcaggccgttccggcggcccttgaaggtgtcccgggggaacagcgagacctcgtccaccttgaccggcgccgagctggagacggtcagccgaccccggtcggtggtggccccggctttcagtgtcgcggtgtacttcttccaggtgtcgccgctgaccgcgatggtcccggtgaccccgccgagctcgatcgtcagcaaggcggtgccccgcgcccacaccgaaaaatcgtacaaatcattcttttgtacggcgatgccgctgttgtagcccgcgttcgtcacgctgccgtcgagggcgagatagttccggttgcgctcgttgagccgctggtcgtcgtcgacgacggtggccgacccggtggcggtccacccggtcagcccggtgaagccggccgcgtcggccgaggtgaactcgaacgaccggttgcgcaccagctcggcgtacagcccgccgtccgccgcgtagttgatgtcctcgaagaacacgccgtactgctgccgggacagcgccgcgccgtcggcctgcggactcaccttgatcgtgtaatccggctggaccggggacgccgagaccggcggcgcgaccgccagcggaagtgacaccaggacggcggcgacgccgaccaggcgggaacggatgcggggcatgaggggtcctccaccgagatgtcggggatgtttccgtgcggggcgctttgcaatgtgtacgcaaacatcgagacccctgtcaagagcagtaagtcgatgtcttgcccgctgagaacagtattgttagcgttaacgcagccgatccgctacacggcttccacaggccggtttactgtcaattgcggacaccccgccacccccgaccattcagatccggttgcgccggtacgccgtcagcccgcgaaccgtcccgctcaccccacccggaacgcttccgcgacgggcctgactttccctccgacgtcgagttcgcgccggcagtcgccacccggctcgatccgcgcggcggtcgagggctgccggcgggaccggtggtttcgcggcggggagtggagtcggtgcggtgggccggtgggcgtcggttaggttcctcgggtggagctgaatgtgtcggtggcggacggggtggcgctgctggagatgcggcggccgccggcgaaccacttcgatgaggagctgatcgggcggatcgtcgaggcggcgttcgcgctcgatgaggatccggcgtgccgggtgatcgtgctggcgtccgaggggaagcacttctgcgccggggcggatttcggcgggggtgacttcgggcgggatcatgtggatgcggcggcgcggctctatcggcgggccatgcagctgttcgacgtgcggacgccgatggtggcggccgtgcaggggaccgcggtgggtggcgggctggggctggcgtgcgcggcggatttccgggtggcggagccggggacgcggttcgtggcgaacttcgcgaagctcggattccacgccggcttcgggctcagcgtgacgctgccggagctcatcgggcggcagaaggcgaccgacatgatgctgaccgcgcggcgggtcggtggggacgaggcgtaccggatcgggctggcggaccggctcgccgaaccggggcgggtgcgggacgcggcccgggcgctggcgaccgagatcgccggggcggcgccgctggcggtgcggtcgatgcgggcgacgctgcgcggcgacctggccgaccgggtgcgacgggcgctcgatcacgaactggccgaacagaagatccactgggcgacgaaggacagcgcggagggcatcacggccagcctcgcccgccgcgcgccggtcttcaccggcgaatgacggcggccgccccggcgccgccgagacgagcggttcgagggccggaagagggagatcagcgtggcgccgggtggcgccgtcagtggccggtggggaagcggaccagcatcgccacgcccgggtcgcgggcctcggcggtgatccggccgccgtgtgcctggaccagctggcggacgatccacaggccgaggccgacgccgcccggcccgctgaccgcgaactgttcgaacaggggtgtcgcgcagcgcgtccgggatgcccggcccgtggtcgcggacctccagccggtccgtgtcgccgtcccggccgaaacggatcaccaccggcgggccgccgtaccggagcgcgttggccaccaggttgagcaggatctgctcgaagcgctgcttgtcgacacacaccgtggccgacgcggagatctcgacctcgatctcctcgtccgcccggacgtaggtcagcgcgtcccgcaccagttcctcggccgcatgtgggcgcaggtcgagggtgaggtggccggtgcggtcgatgcgctgcacgtcgagcaggccgtcggcgagccgggtcagccgggcggtctggcgcagcgccacgtcgagcatgccggcgtcggtgccggtagcctcggcgcgcagttcctcaaggacgatctgcaccgcgctcagcggggtgcgcacgtcgtgggcgagggtgttgaccatggcggcgcgccagcgttcgatccgggacaggcgctcccggtcgtcgcgcaggtgccgggcctgtgcctcgatgagcaggccgacgaccagggcgatcggcatcagcacggcggcgctgccggtcacgaacggtggctgcccggtgaggatcagcggcagcaggtacgcgatggtggccggcgccagaaaggccagcaggatccagcgcgggaagtgcagcgccgcccacgcgaagatcagcaccaggaacgggccggtgccgctggccaccccgccgaacgaccaggtggcgaacccgagcacggcgaaagcgggcaacccgagcagagccggggcgtgccggggcagccggccccacggcatcagcgccgcgggcacggcgacgaccagatcgcacacggcgacggcggccaggcgcgccgtccggtccggctcgacggcgaccccgacgagggcgagcaggccggccacgaccaggagtgcggcgcactgccgggccgcggcgcgcggcccggacccgagcaggcggaacggtccgagctggtctacatggccaacctaggcgacccggttgcgcagcggacggccgtcgcggaaggcggccaggttttcctcgatcaggcgggccgcgcccagcgggcggccgccggctgcgtgcggggtgatgatcacgttgggttcgtcccacaggccggaggcgggcggcagcggctcggtgacgaagacgtccagggcggcaccggcgatccggcccgcgcgcagggcgtcgagcagcgcggcctcgtccagggtgctgccccggcccacgttgaccacccaggcgtgcggcgggaacagggcgaggacgccggcgtccagcacgccggcggtgtcggcggcggccggcaggatcgagaccagcacgtcggcggtgggcagcacctgcgggaggtcggccgcggtgaccaccgggtagccgtgccggtcgccggcggtgcgggccaccccggtgacccgggcgccgagcgcggtcagcagcggggcgagcgtggcggcgatgccaccgaagccccagacgaccacgtgcgcgtcccgcagcgtccggaaggaatgctcctcccggaccggttgcaggccgccgagctcgcccgcccagcggtgcccgatctgcgcccggaccagcaggttgagccggcgggccgcggccagcagcagggccagggtgtgctcggcgacggtctggtcgtgcaggccgagccccgcggtgatcggcacgccgggggcgaacccggcctgcagcaccgcgtccggaccggcggacagggtctgcacccagcgcagccgggtgaggcggcgtgccgcgtcggccagctgcgccgcggtgttgccccagacgaccaggacgtcggcgtcggcgtgctccccggggatcggcgcggtcggggtgtaggtcacgccgatgacaccgtcgggcagggtgacgtcgagctccacggagtcgggcagcagcaccttcatggccggaagcctacgagtgggcgcgcaggtggacgcgttcgccctgcgggccgaagaggttcagcacctcggccgggcccgggccggggttgagcagggcgtgcgggacccgggtgtcgaattcggcggcctcgcccggggtcagcaggatgtcgcggggcccgagcagcaggcggatccggccgctcagcacgtagatccactcgtacccctcatgggtctgttgttccggatcgcagcggtccggggtggccggaatgatctgcttgaaggcctgcacgccgccgggtcggcgggtcagcgggacgtaggtgtgcccgtggcgttcgatcgggcgttgccgcacccgtgggtcgccggtctccggcgcgtcgaccaggtcgtccagcgtgacctggtacgcctcggcgagcggaagcagcagttccagggtgggccggcgggcgccggactccaggcgggacagggtgctgacggagatcccggtggtctcggcgagccgggtcagcgtgatgttccgcttctgccgcagggcgcgcagccgggggccgaccgcggccaggtcctttgccataacggcaaagatacttgccggcctgcgcgacgcggcgcacggtgacggggacggcggtgccctgaggaaggacgacgatggagcggacgtacgacgtgatcgtgatcggcggcggcgcggccggcctgagcggggccgtgacgctggcccgctcgaaccggtcggtgctggtcgtcgacggcggtgagccgcgcaacgccccatccgggcacgtgcacaacctgctcggtcgagaaggcgtcgcgccgaccgagctgtacgcggccggccgggccgaggtcgaggggtacggcggcgaggtgcgcaccggcacggccgagcgggccgagcgggtggacggcggcttcgtggtcaccctggccgggggcgaccgggtggtcgggcggcggctgctggtcaccaccgggctgaccgacgagctgccggacatcccggggctggccgagcactggggtggcgacgtggcgcactgcccgtactgccacggctgggagctgcgcggcaaacggatcggggtgctggtcaccgggccgctcagcctgcacggcgcgcagctctggcggcagctcaccgacgacgtggtctacctgctcaacggcagcccggccccggcgcccgagcaggccgagcagctcgccgcgcggcgtatcccggtggtcgccgaggcggtcgaggcggtgcagagcgacagcgggcggatcagcggtgtgcggctcgcggacggccgggtgatcggcctggaggcgatcgcggtcggcccgcggttggtcgcccggtcggcgttcctggcgtcgctcggcctcgaagcggtgccgatggagctcaacgggcacgtgatgggcatgcggatcgcggccgaggagcgcaccggcgcgaccgcggtgcccggcgtctgggtggccggcaacgtcaccgacctgggcgccaccgtcgcggtcgcggcggccgccgggcagaccgcgggcgccatgatcaacctggatctgatcgcggcggagacccgggacgccgtcgccgagtaccgccgccggcagcagaccatggtcgaggcggacgcctgggaggagcggtaccggggcaaggcggcgatctggagcggtcagccgaacgtgcagctggtcgccgaggcggccgggttgccggccgggcgggcgctcgacgtcggctgcggcgagggcgccgacgccgtctggctcgccgagcgcggctggcaggtgaccgccgtcgacatctcgtcggtcgcgctgatccgggcggccgggcacgccgccgcggccggtctggccgaccggatcaccttccgccatgccgacctgcgccaggaacctcccgcggagggctcctacgacctggtcacggcgcactacatgcacctgccgcggccggatcgccgggagttgtacggccgtctcgccgccgccgtggcccgcggcggcaccctgctcgtggtcggccaccaccccgacgacctggccgagcggccccgcccgatgcacttcccggagatgctgttcaccgcccgggaactcgccgccgagctggaccccggccgctgggaggtgctcaccaccgcgaagcgcccgcgggccgggcaggacggggtgatccacgacgcggtgctggtcgcgcgccgtaaacactgacgttcacgggtgcctttcgggcgaaatcggccgcatgacaccgcttgccttgctgcaatggcttcatgcggccggatgaaggtaacggacagcccggactcggcgacgacgcccgagcggccctcgccgcctggcgtgaccagctcgccgacaccggcgccgcggaccggctgatcgacctgccgcgggccggtgccgacctggtcgagatcaccggcccgggaccggaggcggtcaccggccggctgcgggccggccgggactggtccttcggcccgggcggcggcgacgtgctcgccaccgacctgcccgccgacaccctgcacacgctgctgcggcacctgcggcggcacgcccaccaggagactctcgaccacggcgaggacaccctgcacctggccaccgggctgctgcactggaccgaccgggccggcgccgggcacgccagcccgatcctgctcaccgcggtcgagctggtcgcgctcggccccggcgacgtgccccggctgcgcgccgcgaccggcgacccggtgctcaacccggcactcgccgcccgcctgcgcgagcaccgcgtcgagctcaccgccgacctcggcgcgctgcgtgaacggatcaccggccgcaacggctggcggatcgtcgacacggtggtgctggcccgcttcgacctggccgccgaggcggtccggcaggacctcgccgagcacgaagacctgatcctggcccacccggtggtgcgggcgctggccgccgaggacggcgacttcgcgtttcccccggccaccggcgaacacctcgaaggggacgagccgccgctgctgctggacgccgacgcggaccagcgggcgtgtgtcgccgcggccctggccgggcacagcttcgtgatcgacggcccgcccggaaccggcaagtcgcagaccgtggcgaacatgatcggggcgctcacgcacgccgggaaacgggtgctgttcgtcgccgagacggcctccgccctcgacgtggtgcagcaccggctggccgccgccgggctcggcaactacctgctcgacctgcacgggcagcgggccgggcgcaagcaggtggccgccgcgctcgcggcggccctggaagccgtgccgctgccaccgccgggaatggacgaaacggatcgccggaccctcgcggcgcggcgggagcagctcacgtcgtacgcccaagcagtcaatgagccgcgcgaaccgctcgggctcagcctgcatcaggtggccgggcgccacgcgctgctctccggcgtgccggagagcccggcgccggggctgcaaccgctggcgctgaccgagaccgcgctggaccgggtgctggccgccgcggagcagctcagcggcgcctggcggccggccaccgagcgcagcggattccgctggcgcgaggtgatcgagaaggagccgctcgacggcgcgctgcacgaggcgcaggtcgcgctggaggcgctgaccgaggccaccgaggcgttcgggccgctggccgccgcgttccacgtgcggctcccggtcgacgcggaggagctggcccggctcgtcgcgcatgccgcgacccgccccgccgaggtgcccgaccactggctcaccgcggtcgccctgcgtccgatcagggaggcggcggacaccctggcccggctgaccgccaccgcccgggaggcggcggaacaggcccgcgaacgcaccgggctcagcgccgcccagctcgccgagcaggaggtcgccgagctgccggagcagcccaccctgaacccgccggcggtcggcctggcatcgctgaccgcggccaccgcgaagtcgctggccggccggttcgccgcggacgccgacgagctggaacaccagcagcgcaccctggaccgggtcaccgggcggctggggctgcccgacgtggtcaccttctccgacgtcgaactggtcaccctggtggccgaactgggggcccggccggacaagccggagccggcctggttctccccgggtgcgcaggccggggtgcacgccgcggccggggcgctgcggcggcacgtcgaagcggtggccgaggcccgcaaccgggcccggcagtacttcaccgacgcggtgctgggcgagccggtcgaggagctcgccgaacggttcgcgacggtgcaccgcggggtgcgcaaactgctggccgcgcaccggtgggaccgggagacggtgacggcgctcgccgagccgggggtcagcgccgacgacgcggtggcgaacctgccgctcgcggtggcgtggcggcgcgccaacgaggggctgctcgcggcggaacggcagaacgcggccctgctcgggcggtactggcagcggctggacaccgacttcctggcgatcggccgggccctggagacggtgagcgaagtgctgcgggtgacgccacccgaggcgctggacgcggtgatcgccttcgtctgccaccggggtggcgacggtgagctgctgcgggtcgtgaccgaggcgcgggacgtgttccggcactggcgggccacgcccgaggtggcgcagcggcccgagctggggcagcggtcggtgggtgcggcggtggcgtggctccgcgcccaggtcgggccgctcggggtggccgccggggtgttggagcagctcagcaaggtgaccgggcgcgagctggacctggggtcggccgaggagatcgtggcggcccggacctcggtggtgtccgcctcccgcgccgtgacggaggcgctgcccgggttgcgcgccctgctcggcgatgtcgatctcggctcggtggaccgtgggctcgcctgggcggccgcggcgcggactctgcggagcggggccgacgcggcgctgaccgcggagcaggcggcggccctgcggctggacggcgagaacccggacctgtcggtgttcatcgaggtgtggcaggaggcccggcagcggatcatcgatgccttcgggccggcccggcaggtgcgcctcggcaccgccctcgaccgctacgagaccgcccgtgacctgctgcgcgatctccgcgaggacgacaccggacagcgcgagtggttccagtatctggccgcccgcgaggtgctcgccgaacacggcctggacagcgccatcgaccactgcgccgaccacggcgtcgaggtcggcaaactccggccggtgctcgagcggaccgtgtaccgggcctgggccgacgcggtcatcgccgaggatgaacggctgcagccgctgacctcggtggagcgcaacgagctggtcgaggagttccgccggctcgacgccgacctgatgccggatgccgccgggacgatcatcgaagcgctcaacgcgcgccggccggcgatcaccccggacggcgcgcccgcgctgatccgcgcgcaggaaggccgcctgccggtgcgcgagctgctggaccgcacctgggaagcggccgtcgcgctgaaaccgtgcttcgtcatgccgcccgccgcggtcagccggtacctgcccgccgatcagcgcttcgacgtggtgatcatcgacgaggcgtcgcggatgaccccgggcgccgcggtggcctgcgcgtaccgcggcaggtcactgatcgtgatcggtgacgactgccagctgccaccggccaacggccagccgtcggtgctggtggccgccaacgactgcggggcgttcacccggctggcgctgacccggcactaccgcagccggcacgagacgctgatcagctttgcgaacgaggccttctatcagggacgactcgtcacctatccgagcgcccacccggtcggcgacgacctcgggctggcgctgctgccggcggtggacgcgccggtggaggccgcgctggtggccgagcgggtggcgcaccacttcaccacccgccccacgctgtcactgggcgtggtcaccctgacgcccgggcacgccgacgcggtggccgacgcggtggagaccgtgctcggcgagcggccggacctggagcggttcctcggcgaggatccgctgaccgggttcttcgtcaagccggccgacgcggtgcagggcgacgagcgggacgtgatcatcctggccaccgggccggacctggcggccgccggaggaccggtgggcgcgcgcaagctgaacgtggcgatcacccgggcccggcagcgcgtcgaggtggtcacctcggtttccgagcggcgacgcgaggagccggcggacgagggggagcgccggctcgcggactatctggcgccgaccgcggcaccggccgccgccaccaccgccatctccgacatcgccgaatacgtcgcctcgctgatcgaaggctgggggttcgcggtcacccgccgggccggcgccggtcactgccgcatcgacatcggcgtacgccattccactctcgacgcgtacgccctgggcgtgcagtgcgacggacccgaatacgccggcaccccggcccgcgaccgggaccggctgcgtgaacaggtgctgcacgccctcggctggcacctgcaccgggtgtggagcgtcgcctggtaccacgaccgcgccgaggaggaggcccggctgcgcgccgccatcgagaacgccctggccgtccccgacgtcttcgccgaacccgacctggaactggtcacccgcccggctcaaccgcccgaatgggcgctgccgtaccagcacgcccagctcgagccgctgcccccggccgcccgggtcaacgaccaggtcgtccgtaccctgctggaacgcaccgtcgagacgatcgccgaggtggagggtccggtccacatcgccgtgctcacccggcgcatccgcgaggggtggggcatcaaccggatcacccagccgatccgccaggccatcgaagcggccatcgcgtcgtccacggtaggtttcgacggcaccttcatcacagcggccgtcgccccgatacccgccgtccgggtcccgggcgacggggtggcccgcaaacccgaacaggtcgccgagtcggagctgcagctggcgctggaatacctggtcctcgacgccgggctggtggaaagcgacgacctgctggccgcggcggcccgcctgttcggctggccggccaacaagaccggctcggcccggctcgccgcgatgctcgacgacctggtggcgggcgggcggctgatcgcccaccgcaacggcctgatcgccgccccggagaacgacctgctcgacctcccggatccggccacccttccgcaccgcccggacgccgcgaccgtggacctggagacggaggccgccggccgcagctaggcccccggacggtgtcatcccggtggaatgctcggcataatcgccgggtgacaccaccgcaagatccccgggggtccgtgccggctccgcagccaccgttccggtggaagacgtggcacaaggtcaccatcggcgtggtcggtgcgaccacgctgctcggctgcgggacggcgatcgtcacgctcatcccggggagaccggagaggacggtcgccgccggcgcgaccaccctgcccgtggtgaccgcggccaccacggcggccacggcgtccccgtccgcgccggtcccgcccgggccggcgtcgaaggccggaccctccccgaccgccctgcggacctcaccaccggtctcctacgccgactgcgatgcggtgatcgcggcgggcgccgcgccgatccgcaccggccagcccggcttccggaaggccttcgacaccgacggcgacggggtgggctgcgaacccgccgacggcgtcccggcgaccccgtcccgcgaacccggccccaccgacgacggcgggctcgacccgcgcttcccgaactgcgccaaggccagagccgccgggtacggcccgtaccaccgcggcaccgaccccgaatacgactggtacaaagatcacgacaaggacggcgtggcctgcgactaggcgacgatcaccgccggggcgccgcggggacggcgggaccggtcagcggacggggacaccccggccgggctcgcggtgcggggacaccgtgcggtgccggatgcgccagccgtgcccggtccggacgaggtgatccgcgtaggtgaagctggcgacccggccgtcctcgcccacggtcatccccttcgaccaggcacgggcaccgtcgccgtcggcgcggacgatgatgttggtgacgtgcatggcgagcgtgctgcccggcccgcgtcgccgggcgacctcgatgtaggtcgccaggctcggccgggatgccggtccggtgcggaccggttcataaccgagggcgctgacgtccacctgcaggtccgcggtgaacaccaggtcgaagcggtcgtagtcgccggcgtcgcacaggtgaccgtgcagcgcgagcacttcgtggatctccaggcggtcctcggcggtcaggctcatcggctactccccaggcatcgacgatcggcgacagccgaggctagccgacggtgaccgcccgggtgaccgtcggctggtcgtcgcccgggtggaccgcgtcgctgtacagcaggcggatgacctcggtgtccagcgccgagtacttctgcggggtggccgagtatctgttgtagaagacgctgtccggatacttaccggagctgttggccagacccatcgctccggtcagctcctcgcggatcagatggcagcggacggtccggctgatcccggtcgagcggatcagcacggtggcgcgggtgatcacgttctggccggaccagtgcatgtagaagaatccgtcgttgccggcgacgtagctcggctcgagggaccggaaccgggagaccggcgcgaagtgcatctcgatgtcggccggcccggaggccagtgccagatcggacgtcccggacagggcgttgaagtcggtgatcacccggttcaggcaggtccggctcgccgcgtcgccgccgtggaccccgatggtgaccgtggggtgggtccacttgaccacggcgtgggcgtcggtgccgtacctggcgctgagcgcgacggtgaagaagtaggcgagccccgccttgctgatcttcggctttgccggcggcggggtgggtgcggcgatgaccgggggcaccgggacgacgctggatgacgggggcgtgacggcggtgtgggcggccggcgagccacacgcggcgaggcccagcagtgccaccgatgccaggggcaacctccgacccatgatgccgctccccccaccgtcgtgtgtgccgggcgagatcgtaccggcggagcggttgcccgggatcgacgtgggggtgacgccttttctgacgcaccgcggaatgggaaacctccgggggttgtgagtcggctcacccggtcgtagggttaccggcgagttaagttcccgtcacgctcgaagggtcctgttgtggagttctggctcgatctcaacgaggaacaaacggatctgcgcgactgggtccacggcttcgccgagcaggtcatccggccggccgcggccgagtgggacgagcgcgaacagacgccctggccggtgctgcaggaggcggccaagatcgggctgtacgggttcgagttcctgatcaacacgtgggccgacaacaccgggctgtcgctgccgatcgcgaacgaggagctgttctggggtgacggcgggatcgggatggcgatctccgggacctcgctggcggtggccgcgatctacggctccgggacgcccgagcagctcgtcgagtgggtgccgcagtgcttcggggacgccgacgagccgaaggtggcggcgttctgctcgaccgagccggaggccggctccgacgtggcgtcgatgcggacccgggcggtctaccacgaggcgaccgacgagtgggtgatcaccggtcagaaggcgtatgcgaccaatggcggcatcgccaacgtgcatgtggtcaccgcgagtgtcgacccggcgctcggctccaaggggcaggccgcgttcgtcgtgccgcccgggacggccggcctggtcggcacgaagaagctgaagaagctcggcctgcgcgcctcgcacaccgccgacgtgttcctcgacgacgtgcggatcccgggcagctgcctgctcggcggcaaggaggcgctcgacgagcggctggccaaagcccgctccggcgtcaagcgcagcggacaggccgcgatgcggaccttcgagctctcccgccccgcggtcggcgcccaggcgatcggcatcgcccgcggcgcgtacgagtacgcgctggagtacgcgaagaaccgggtcgccttcggccggccgatcatcgagaaccaggcgatcgcgttcgctctcgccgacatgaagatggagatcgacgcggcgcggctgctggtctggcgggccgcctggatggggcgcaacgacaagccgttcaccgccggtgagggctcgatgtcgaagctcaaggccggcgaggtggcggtcgcggtcaccgagaaggccgtgcagatcctcggcggcgccggttacctgcgcgagcacccggtggagcggatgttccgggacgccaagatctacacgatcttcgagggcacctcagagatccagcgcctggtcatctcccgggcgatctccggcatgcagatccgctgacggggaccacgaagctgacgggatcacgacatggacgcgcttttcgtcggtgccacgatgctgcggcgcggactgctgaacccgggcaacccgatccggatcgtccagcagttcgcggcactcggccggtggggcttcgggctcgccggtgagctccggcaggcggccgcccgcagcccgcggcggatcgcggtgatcgacgatcagcggacattgacgtacgcccaattgctgaaccgcgccgaaaagctggcccgcggcctgccggtggccccgggggagcgggtcgggattctgtgccgcaactcggcgcggatgatcgaggcgctgatcggcgtgaccagcgtcggcgccgacccggtgctgatgaataccggtctgtcggcccaccagatggtgaccgtcgccaaggaccagggtctgcgggcgctgcacttcgacgacgagttcgcgccgacggtcgccctggtcgagggcgtggagaagatcagcgaggaacgcttcgaggaactgatcgccggtgctccggcaggatcgggaacggtcccgccggagcgccccgggcgaacgatcgtgctcacctccggcaccacgggtgtgccgaaaggcgcgcggcgccccacgccgggcggattccggccgctctgttcggtgatcgaccggattccgctgcgcgccgaggaccgcgtgatgatcgccgcgccgctcttccacacctggggctatgccgggctgcagatcgcgctggcgctgcgggcgacggtggtgctgcgccgcagattcgagccggccgcgatcgtgcacgacctggtgcggcacgcctgcaccggcatgatcgccgtgccggtcatggtgcagcagctgatggagctggccgagccgccggccaagcccggcctgcgggtggtggcgatcagcggctcggcgctgcccggcggcctggccacccggttcatggaccggtacggcgacgtcctctacaacctctacggctcgacggaggcctcctgggcgtcgatcgccaccccggaggacctgcgcttcgcgcccgacaccgcaggaagacccccctacggtacgaaggtggcagtgctcgacgagcacggcgacccggtgccgcgcggtgcggtcggccgcctgttcgtcggcaacgagatgctcttcgagggctacacgaacggcgccgcgaaactgatgcgcgacggcctgctcgccaccggcgacctgggccatgtcgacgccaccggccgcgtctatgtggacggccgggaggacgacatgatcgtctccggcggggagaacgtgtaccccgccgaggtcgagggcctgctcgccgacctgccccaggtgcgcgaggtcgcggtgatcggcgtgcccgacgacgaatacggtcagcggctcgccgcctacctggtgctccgcgacggcgagaccctcgacccggaagcggtccgcgagcacgtccgccaccaccgcgcccgattcagcgtcccccgcgacgtgaccttcctggacgcgctgccccgcaacgccaccggcaaggtggtcacccgggacctgccgcgctagctccagcgcaggacgccgtggtgcggctgggtcgccaccatggtgatcaggatgatgaagtcggcgatgccgagcagcaccgcggcggtcgcggccgtccgcccccaccgcccgggcgtgccgcgacgcagcgcggtcagccccagcgcgaacgccagcacgccgaagaagacactgaacaggaacagcccggccgccccgaacgcgaccgccgccccggtccgcccatcgaccggcaccacggccaactcgtcccgcggctgcaccgcgagctcacccggcgacccggccgccacccccaccggccgccgccgccggaccacgtgcccgtgcgtgatcaccagcgagatcgcgccggccagcacccccagcaccaggaacacccacgggtgcccgctgagcgtcaccggcccggccgccagcacccacacgatcagtcccgccgcgaaaagcatggagcaacctccctcgatagcggcctccttaccccaccttcccggcggccatgcgtcgccgcggccaggtggcgcgcagctctgcgtcagatggtgagatcccgccgtcggtccggggcctcgggcgagccggcggcggggatcgtctgtggactctcctattgaatcgatgggagataaatactatggtcgcggcatgctctcatcgaagactttcggtcggcgggcggtgctggccgccgcagccggtgcgggcgccgccgtggtgctggcgccgtcggcggaggcggccggcgcggccgacgggcggaacgacacgctgctcgactggtacgacctgaccgccaccaccatcggcgtcgtcaccgggccgcagcaggtcaccaacagccgaacctgggcgatcgcctggatcgccgcctggcgcgcggtgtccatggtgcgcggcggggccgacgccgaactcgccctggccgccgccgtccacgaaaccctgatcaccaccaacccggccgcgaccgccgcactggatgccgcgctggcggcgaccctggcccggctgagcgtccggcacccggatcgggtcgtcgccgccggggcggacgcggcccgcgcggtgctcgccgagcgggccggcgacgggctcgacccggcatcggtcaaccggccgtacccgccgccggccgcggcaccgggggtgtggcagccgacgccgccggcgttcgcctcgccggtgcagtccggtcagggggacggccggccgttcctggtgcgcattgtggagccgctgcagccggggccgccgccggacctggacagcgacatcttcctgcgggatctcgccgagtcccgggcggtcggcgcggtggacagcacggtgcggaccgcggagcagaccgcggtggcccggttctggtcgcagtcgtcgctgaacgggttcaccggggcgctgcggacgacgctcgcacccggcgggtcgcatgccggccggcggcggccgctgcgggagcgggtcggtctgatcgccctgttccacgcggcgacgatcgatgcgcagatcacgacgtaccaggctaaatatcggttcctgcgctggcggccggtgacggcgatccggaccgggtcggtggaccccgacccggactggacgccgctgctcgccaccccggcgcaccccgagtatccgtccggtcacaccacctacgccggggcggcgcaggccgtgctcgacaccctcgccggtccgccgcgggccgcgttcaccctgaccagcgcggtggcgacggacgtgacgcggacctatcgccgctggtcggagctgacccgggacaacatcgacgcccgcgtctgggagggcgtgcacttccgcaacaccgacgagacgggtgcggcggtcggccgccgcgcggcgctcgccgggctggcccgctggcacggccggccgatctgaaagccgcttccggttgacggcgtgccgggccggcaggatggcccggatgcgactgtcgatcgtggaggacgagcgggagctcgccgagtcgctgcgtcgtgggctcaccgccgagggttacccggtggatgtggcccacgacggcagcaccgggctcgagttcgcgatgacacacgcctaccaggtagacccgggaccggctcgccgacgcggtcgagcggcagcgccggttcgtcgccgacgccgcgcaccaactccgcagcccgctcgccggcccgcgcacacggtcgaggtcgcacccgccgacggcgacaccgccgaccgtgcccaccatttccacccgatcgcggtgagcgacccgctgcggtcggcgccggacggctacctgctgatcgcccggagcgtcggtgtcacggtggatcaccggtgagcgtgtcccaggcggccatcgcgcaggtgatcacggattccaggtcgtcccgggtggcgccgtcccgggcctggatcgacagcccctggaccacggtcgcgtagtagcgggccatgccgtcgaggacagcggccggcacgttgtcggcgagccgcgcgcggatcagctcccgctggccgcggcgtccggccgcgagaaactcgcggatcgcgtggttttccaccgcgccggtcggggcggccagcaccagcatgcagtagtgcggtgtgtccggcccggtgacctggtcggcggtggcgcgcagcatctcgtggatcgccgtccgggcatccgggtgctcgcgcagcgcccgccgcggcggctcgccgtggatcttgccgtagcgggtcatcacctggcggaacaggttctccttggtgccgaagcacgcatggatgctggccgaggcgatccccatggcctgtgcgaggtcgctgagtgaggtgccctcgtagccgtgttcccagaacacgtcgagcgcctggcgcagggcggtgtccgggtcgaaggtgcgcggtctgccgcggttcgccatgggcatacgcctccggcctcgggtggggtaatttgttggtcggtcgacaaacaattatagggagccgagcgtgcgagcacttcagcagacctcattgaccggccccgagggcctccgcctgatcgccgacgcgccgatcccgagccccggcccgggcgagttgttgatcaaggtgtccgccgcggggatcaacttcgtggattgctcgtacgcccgcggcaccttcgccggtggacccgcagtgccctacgtggccggcatcgaggccgccggtgcggtggtcgccctcggtcccggcgtgaccggcccgccgcccgggacactcgtcgtcggcgtgcacaccggcggcggcgccttcgccgaattcatgctgctgcccgccgccgcggcggtgccggtcccgcccggctgggccgccgagcaggcgctcggcctgctggtgaactggcccaccgcgctggccgcgctgaaacccctgggcggcctcaccgcgggccagaccgtgctgatccacgccgccgcgggcggcaccgggcaggccgcggtccggatggccaaacactacggcgcgaccgtgctcgccaccgcctcgccgggcaagcacgacgtggtccgcgagctgggcgccgaccacgtcctggactcgcgcggcaccgatctggccgccgaggtgctgcggctgaccggcggcgtcgacctggtgctcgagtcggccggcggtgccaccctggaggccagcctggccgcggcgaagcgggtcaccgggcgggtcgtcgtctacgggctggccgggggaacggccacgatcagcaactgggacctggtctaccggcaccaggtgcatctgatcggcctgaacatcggcatcctgatccaggccgcgccacagctcttcggtgaggtgatgggcgagctgttcacgctgatcggggccggggtgctcgcccccggccggccggtcctgcacgacctcgccgacggcccgacggtgctcgccgagctggaggcccggtcgacggtcggcaaacaggcgctgcgtctctagagctgttcccagcgctgtcgtcgctcgtcgagggtctgctcccaccacggggtgccgcgctcgccgagcgcgaccttcgcggcgtgcacccgggcgcgggccggggccgggtcctcgccggcgcgcagggccgtgccgacgtcgcgccgcgcggccatcagcgccttgcgcagctcggcggccacctcctcggggatcgccgggtcggtggcccgccagcggcggcccttgatgacgacatagtggtcgctcacggtcacccagcctatccgccgacccccggcgtcacccgagctcggtcacggtcacccagcctgtccgccgacccccggcgtcacccgagctcggtcacggtcacggtcacccagcctgtccgccgggccgcggcgtcacccgaactcgatctccaccagcgggctgccggcgatccagctttccaggctgccacccccgccgagccccggcacgatgtcgccgaacacccgcgcccgctcccgcgcgtcggtcaccggccgcccgcgggccggcacgtccaggcccgccaggtgcagggtgaacgcgggctgggcgagaaggttcgcataccagtcccgcgacccggggctgccggtcagccagtagcggccggccgcccggtatcgccacgtctcgatccggcggggcgtgccgctgcgccgcccgatcgtcgtgatctccacggtctgctgcccgtccagcagccgccgcacctcatcggtcaccgtcatgccgtcatcctgcgacctcaacccggcttcacctcaaggcggcggaccatgccgaggcgcggaatcgccggcggcggcggaccgggcgatccgggacggacatgccgacgcagcgcggtggcgagccggcgtgggttccggcgcaggaggtgccgacgcagcgcggtggcgagccggcgtgggttccggcgcaggaggtgccgacgcagcgcggtggcgagccggcgtgggttccggcgcaggaggtgccggggtacccggcgtgtgccgcgatgcgcggccgcggccctcctcgggcagagccgaccggagctagccgccggtgatcgtgccggtcaggtgggtacgcttcgagaccaccgcgaaatcccagtcgtcgccggtgagggtggcggtgaagcggaccgtggacggcagcaggatcggttgtctgaaggacacttcgacggtgtacgcgtcggggaggcgaccttccagggcggccaggcagcgggccttggtccacatcccgtgcgcgatctgccgggagaatccgaaaagccgggcgcccaggcgcgacgtgtggatggggttgcgatcgccggagaccgcggcgtaatccgtcccgacccgggtcggcagccgccagaccgccccaccggatgaaccggagacatccggcttcgggaaccgggtcgctgcgccgccgagcggagcgttccccgacccgcgggcggagccgccgccggcgttgcgaccggtgccggtgccggtgccggtgtcacgagcaccgccgccggccgacgtgatccgcaggtaggtcgagacgtcctcccagaccacctcatcgtccaccgaagccgtcgccaccatgtcgaactgccgcccccgcggatgatcccgcagatccaccgcccgtacccgcagatccagccgggcccccgcgtcgatcggcgcccgcaccgtgatccggttcgacacgtgcaccagcccgatcatcggcagcggaaagtccccgtccgacatcagccgcatcgccagcggaaacgccagcacatgcgggtacgtcgccggcagcgtgtcgccgagccgcagcccgcacacccggtcgtaccgcgccagatgcgcccggtccacgctcaccccgcggtgcaccagctccacgtcgggcagcgccgacccgccccggcgcagcatgccgagcgcggccttggcgtacgccgcgctcgttcccggcccctcggtcaactccacgaccgccaccatcggtcaggcccccagcagactctggccgcagacccgcaccacgttcccggtgatcgccgccgacccgggggaggcgaaccaggcgatcgtctcggccacgtcgaccggcaggccgccctgcgacatgctgttcagccggcggccggcctcacgcagcccgatcggcatcttcgcggtcatcgcggtctcgatgaagccgggcgccaccgcgttgatcgtgatgtccttcccggcgagcagcggcgcggtcgactggaccagtccgatcacgccggccttgctggtcgcgtagttggtctgcccgcggttgccggcgatcccggcgatcgaggcgacgccgacgatccggccgcccggcttgatcaggtcgcgttccagcagcaggtcgttgacgcgttccggggcggtcaggttgaccccgatcaccgagtcccagcggctctcgtccatccgcgcgatcgtcttgtcccgggtgatcccggcgttgtgcaccaggatgtcgacgccgccgtgcgggccggccgcgaggtatccggcgagccgcgccggcgcgtcctcggcggtcaggtcgagttgcagcgcccggccgcgcgcccggttcgccacgtcggccagcgcgtcgccggcgccgggcacgtccagcgcgatcacctcggcgccgtcgcgggccagggtcgccgcgatcgatgcgccgatgcctcgggccgcgccggtgaccagggcgagtttgccggtcagtggcttgtcccagtcggcgggggtcggggctgcggtcgcgccgatccggatgacctggccggacacgtaggcggatttcccgctgagcaggaagcgcagggtggactcgaccgactgctcgcccccgggtgccacgtagaccagctggctggtgctgccccggccgaattccttgccgatgctgcgggtcagaccctccaggctccgctgcgcggtcgcctctttcgggtccgcggcggcttccggtggcgtgcccagcacgatgacccggccgctcggggtcaggctgcgggcgtacgggtggaagtagtcgaagagcgcccggagccccgccgaggtggtgatgccggtcgcgtcgaagatcagggcggcgtgtttcgccccgtccgcgccctcggtgaccacctgcaccccggcgtcctgcagcagtttgccgaccgggtcggcgagtcgtccgccgggcgcggcgccgagcagcaccggagcggacgccaccgggtcgcccgggcggtaccgtcgcaggcggggcgggtcgggcaagccgagacgcttgaccacggcccggccgagaccggagttggcgaagttcgcgtacctgtcagccatgcgagtaccctaccggtcagtagctttgccgtcgtcgatgtcgtggatagatctgtggaggattccgtgccgaccgtgcgccgtgtcgccgtcctgggcggtaaccgtatcccgttcgcccggtcgaacagcaggtatgccgccgcttcgaaccaggacatgctgaccgccgcgttggacggcctggtcgcccggttcggtctggccggcgagcggctcggtgaggtggtggccggcgccgtgctcaagcactcccgcgacttcaacctgacccgcgaggtggtgctgggctcgcggctcgacccgcacaccccggcctacgacatccagcaggcctgcggcaccgggctggaggcggccatcctggtcgccaacaagatcgcgctgggccagatcgacgtcggcgtggccggtggcgtggacaccacctcggacgcgccgctgcaggtgaacgaggacatgcggcaggcgctgctggagctgaaccgggcgcggacgctgggcgcgcggctgaaggcggtcgccaagctgcgcccgcagcacgcgctgcagccggagatcccgcgcaactccgagccccgcaccggcctgtcgatgggcgagcacgctgcgatcaccgcggcgaggtggaacgtgtcgcgcgaggatcaggacgcgctcgcgctgacctcgcatcagcgcctggccgccgcgtacgacagtcggttcttcgacgatctgatgaccccctacctggggctgacccgcgaccagaatctgcgggccgacagcagcctggagaaactcgcgaagctgaagccggtgtacggcaaggagaacgcgacgatgacggcgggcaactcgaccccgctgaccgacggcgcgtcgaccgtgctgctggcctcgcaggagtgggccgccgcgcactcactgccggtcctggcgtatttcgcggactgcgagacggcggcggtcgactacgtgcacggcgacgaggggctgctgatggccccggcgtacgcggtgccgcggatgctcgcccgcaacggcctcaccctgcaggacttcgactactacgagatccacgaggcgttcgcgtcgcaggtgctgtccaccctggcggcctgggagtcgccggagttctgcaaggcgaagctcggcctggacgcgccgctcgggtcgatcgaccgggccaagctcaacgtcaacggctcctcactggcggccggccacccgttcgcggcgaccggcggccggatcgtcgccaccctggccaagctgctcagccgacggggcgccggccgcggcctgatctccatctgcgcggccggtggccagggcgtcgtcgccatcctggagcgctgagccgacccgccacgcacgctgacgcctggtccacggcagatccggacacccgccggcacgtgatcgctgcacgtgccgcgcggggtgggcgccgcggccggatcagcgctcagcggccatccgggtacgggctgacgacggccggccgggtcgccgccggcggggccgagtcgcggacgttcttctggacggcgacgacggcgaacaggctcatcgcgaaagcgaggccgtagaagccgcgctcgctcaacgccagaccgctgttccacagtccgatcgtcatcatcacgatggagaggccgacgatgatgccggcgacgcccagatagaggttcgtcaccggcacgccctcggcccggtcgcggaccgacttctgcagggagagagcaccgaacaggcccagcaggagcgtcgcggcgtagaagccgacctcgctcttggtcatgtgcgagttccacaggccgacggcgaacgacgcgatgccgagcccgagggcgacccaggacgcgccgacgaacgctgcggtcggcttctgcggaacggacggcggctggtacgacactatggctctccggtagtcggatcgggaggtgcggatcgccatcgtcttcggcttcgccggccggcacctgagcgtcgtgacccgtttgtcgcaggccgccgaccgttcgtccgcgggttcccgcccgactgtcgcgaccggccggctaacagcgcagccggcgggcctcgcgctccggatcgtcggccgtggtggccgccggggccggctcgtcgcagttcaggatgccgtcggtcagcacggcgctccaggtgatcacggtgccgtcggtggtggtgccgccgcaggtgtagtggaagggcacgtccagggtgcgcagccactcgtaggcgacgaagcggccggtgcggtccatgctgaacgactcgccggtggccgggtggtacacctcgccgtagggggccagcggatggtcctccccgtaccggccggcaagctcccggtagatctgctcggccggcgccgtcgccgcggtccgcaccgcggcggtccgggtgttgatctggtcgtacgggtcggtgaacaccacgtccctggcaagccccttctcgaccggggtgacgccggtgagcagtttgccggtgaccgccttggcgaacacggtctgcccgccggtgcacacggccggcgcgggcgccgcggccgggtgtgcccggccggtggtgcagccggccagcaggagcagcgcgacgagggaaaggggccgccgggtcatgtgtcgatcatgacggcccccgcgaccttccggtatcaggccgccgtgcaggtggccgtgcccgaaggggccgacccggtgccctggaagccgaagctggtgccggctccggcggcgacgccgagttgatgtgcgacgggaagccgacgcagtcgatcggcactccgcgcgccaggaagcccttgaccatggtgtagacggcggtgttcaccacgtcccaggcgtagatccggcccaggtagtgggtggccacggtggtgatgtggttgaccatcgcgctgcgcagcgccgacccgctcagcgacgacaccccgccgggctgctgctggtgccaggccagcgcgtggccgcgcatccgctgcccgttcgccgtgcccgggccacgatggcgtccccgcccgcgtagcggaacgagttctgcgacggctcggtggcacgggttgtcggtggctgtccgccgggccggtccccgggtgcggtaggttgccgcgcatgcagactggtgtgcaggcggccgtcccggtgctgtacgtgcggagcatcgagtccgctcgccggttctacgcgctgttcggctacggcgagtcgagagcgggcggcgacggtgccgcgcgctggtcgtatctgcagtgtggtgagcacacgctgctgctggccggggtccagccgccgctcatccaggtcgagctgccgctgctgatctacctgtacgtcacggatctggccgcggtgcgtgaccggctggacgaggccggtcacgagtacgagatggccgggtatccggagcacgcgcccggcggcgagctgcgcacccgcgaccccgacggcaacgtggtgctcgtcggccagcgcacggcgatcgccgccgacgcccgggtcgagaccaccgggccgcaggcgcggttctcgctgatccggcaggcggccgaggcggtcagccggcgcggcggggcgccggcctcctgccagatcggggccgcggacggcagtgcatgcccgaagccggccgaggtcaagctggcggacacctggggtgcgacggtctggggctgcctgagtcacgtcgacgaggcgttgatcaacgcgcgcgggacgttcatcgccacggaggacggccaggggctcggaccctggctcagccaccgctcacgacgaccctgacatcggcgaggcgccgacccccgtccggctgccaggcggtgccgccggtcgggccggcggccaagcggtggccgccggtcgggccggtggccaagcggtgccgccggtcccgccgtgcccaagcgggtcgctaggtggctaggcgtagcgcctccgcgacggcggccgcggccgcggccgcgtcctccccctcggcgtgcacggtcaccgtcgcccccgcggtcacgcccagcgacatcagtttcagggcgctgcgcgcgctcgccgaccgggccccgtgccggatctcgacggcggccgggaagcgggccgccgcccggaccacctcgccggccggtcgggcgtgcagcgccgccggcaggaccacctcgagctcagaacttggcgacatcgcgagcctcccgtgccgcctcggccaccgccgccggcccggctccggtcgacgcggtgaccgccgccgccatcgccccctccacgaacggcgcgtcgaccagcagcgggcccggcgtgtcggcgaggaccgcccgggcggtcagcaccgcgctacccaggtcggccaggatgaccacgcccgctccggtgtcggcggccgcgatcgccgcgctcagccggtcggggctggtgcccaggtcgccgtcgtcggtgccggcggccggctcgatccggacctcgtcgccggcgacctggcgcagcaggtcgcgcaggcctgacgccaactgctcggagtgcgaaaccagcacgattcccacgagccccatggatctcgactctagaccgcgcgaggatgcagtgggtgcacggagaacagcggagaggagccggtcgtgaagaaattcatcaacgatcctgccgatgtggtggccgaagccctcagggggctggccgccgcccacccggagttgcgggtggacaccggggagcagtacatcgcacgggccgacgcgccgcgggccggcaaggtgggcctggtctccggcggcggttccgggcacgagccgctgcacggcgggttcgtcggaccgggcatgttggacgcggcctgccccggtgaggtcttcacctcgccggtgcccgaccagatcctggcggccaccaaggccgtcgacggtggcgccggggtggtgcacgtggtgaagaactacaccggtgacgtgatgaatttccagctcgccgcggagctcgccaccgaagaggggatcagcgtcgagacggtgctggtcgacgacgacgtcgcggtcgaggattcgacatggacggcgggccgccggggcaccggcgcgacgctgctggtggagaagatcgccggcgcgcgcgccgaggagggcggcaagctcggcgaggtcgccgcgatcgggcgcgaggtcaacgctgcctccggctctttcgcgtacgcgttgaccgccggcaccacgcccgccgccggccgccccggcttcgacctgccggccgacgagatcgaggcgggtgtcggcatccacggcgagccgggccgccgccgggagaagctgcgcccggccaaggacctggtgcacgccgcgctggacgcgatcctggacgccaaacagtttcccggcccggtgatcgtgctggtcaacggcctcggcggcaccccgctgatcgagctgtacctgatctacggcgaggtcgccgcggtcctggagcagcgcggcgtgccgatcgcccgcaagctcgtcggcaactatgtgaccagcctcgacatggccggcatgtcgctcaccctgtgccaggccaccgacgagatgctccgcctctgggacgccccggtgcgcacccccggcctgcgctggggtgcctgagcatggatgcgacgctcgcccgggactggatgcgcgccgcggccgccgcggtggcggccgagaccgaccggctgacccggctggattccgcgatcggcgacggcgatcacggcgtcaacctgaaccggggtttcgccgccgtggtggcggctctcgacgccggcgcggaggacaccccggcggccgtgctgaccagggccgggaccacgctgatggcgcgggtgggcggcgcctccggcccgctctacggcagcgcgctgcgggccgccggcaaggcgttgccggacaccgccgcggtcgaggccaccgacctggtcgccgccctgcacgccgggctggaggcggtccgcaggctcggcggtgccgcgcccggggacaagaccatgatcgacgcgtacgcgccggctctggcggtcttcgagcggtccgtcgccgggggagcggacctcgccggggcgtccgccgaggccgccgaggccgctgcggcgggagcggccgccaccgtgccgttgcgggcccgcaagggccgcgcctcctacctgggtgagcgcagcatcggccatcaggacccgggcgctacctcgaccagcctcatttttcaagcactggccgcggtttcttaggtggaaggcagttctgccgattcagcgggtgttgaatactgctgaaagaggtaacgcgatgggtgtgggcggggcgttcgacaaccgctccctgcggacgaagatcgtcgcggcggcgctgaccgccgcggtcggcggtctgatcgtgggcgggatgtcgatcatgacggtgcgcgggctgaaccagaaggcggccgacgcgcagcacaagtccatcgcgatcgagacggcggtcagcggtttcagcaggaatctcgaggcgttcgtcggcagcaattccgccatgcagctctacccgtcgcaggcggcgcagatcggtgccgtggccgcgcagtacaagcaggccgccaccgacgcgttgaccagtcttggcgccgagctgcccggcgacgccacggtgacccggacgcagcaggattgggacagcttcctgcagttcctcggttcgacagcggcctcggaccacccgctgagcaaggcggagatcgtggccggcctggcgcagtacggcaagctgcacgacgcgctgggcgccgacgggaacgcgctgcaggcccgggccgccgcggtcgccgagacgcagatcgccgacgcgcgttccgccgccaactccgccacctggaccattgccggggtgctcgccgccggggtggtgctcagcatgctgatcggcttccgggtggccgcccgggtgcgcgacgccgtccgcggtgtctcccggctcgccgagggcctggccgagggcgacctgacccgcacctccggggtgaccacccgggacgaggtggggcagatggccgccgcactcgactccggcatcgcccggctgcgcgaggacgtggtgcagctggccggcagcgccaccaccctgcagcacgccgccactcagctgacctcggtctccagcgcggtcgacgcggccgccaccgaggcgtcgtcgcaggccggcacggtctccgcggcggccgacaacgtctccaacaacctgcagttcgtctcgtccggcgcccaggagatgggctcggcgatccgcgacatcagcgtctccacctcggaggcgacccaggtggtggtgcaggcggtgcaggcggccgcggccaccaacgcgatcgtggcccggctcggcgagtcgtccgcggagatcgccaccgtggtcaaggtgatcaccagcatcgccgagcagaccaacctgctcgcgctgaacgcgaccatcgaggcagcccgcgccggtgagctcggcaagggcttcgcggtggtggccggcgaggtcaaggacctggcccaggagaccgcgaaggcgaccgaggacatctcccggcgggtgcagtcgatccagaccgacaccagcggcgcggtcagcgcgatcgaggagatcagcgagatcatcgagcggatcaacggcctgcagctgaccatcgcctcggccgtcgaggagcagaccgccaccacccaggagatgaaccgcaccctggccgaggcggccggcggcgccggcaacatcgcggccaccatcaccggggtgtcggaagcgacccggcgcaccaccgacacggtcggcgagacccgccgggcggccgacgagctgaccgccacggccggccagctgcagaccgtggtctcccgcttccgttactgacgcatcgatgccagtgttaggggcatgtatccgcccgagccctggcacctgcgcggacagatgtatctgtcggtcttcctgataccgctgcgggacgtgccgccgctgcccggggtgctgggcgcggcggcacgtccgttgtcgttcggcggccgggccgcgatcggcgcggcctgggtcgactatcaacccggcggcgtcctgcactaccgcgagttgctcagcgcggtgctgacccacgagcgcggccggccgcgggtcagcatcaccgacatctgggtggacagcgtcgcctcccgcgacggcggccgcaacctgtggggcatcccgaaggacctggccggcttcaccctggacgccgacgacgacctgatcgacgcgacggccacggcgccggatggcgccccgatcgccgcggccctgatccggttgaagagccggcttccgggccgcttcccgctggggttcaccgtcgcccaggcgctgggcgggcacgtcaagcgcaccccggtgcgcggccgatcaggcctgcgtacgtcgcaggccgcctggcgccccgacccggccggcccgctcgcctacctggccggccaccgcccgctgctgagcctggcgatcaccgacttctggctcaccttcggtcgcaccgccgccgaccgcgcggccaccgcccgcccccgctgacccgcccgcggtcagcacttcttccaggccacccggtacaccgtgttgatcgcggcgtcggtcgagtccatcgagatgaagctggtgtaccggtgcgcgtccgaggtgccgcggttgacccgcaggtcggtgttgatgttcaggtagcggcgctcgccgcacggcaggtagctcagcgacgcgatgccgacctggtcggtgcgctgccagtcgtcgtcgaccgggccccggaaggtgtgctcgatccgggtggtctgggaatggccctggaagtagtagttggccgcctcctgcgcccacgccccccgggccagtgacgcgtatccgcggtaatccgcgctggcgatcgcgaacgtgaatccggacggcaccttgatgtcgagggccagctggcaattcttccggaaatcgagcggggaggcttgcgggccgacctgcgcggtgtaatccgagtaggtgacggtgaacgcggtgttgtccggcgagacggtgatcttcgcggatttgtccgggcagcccgagccgttcgcgttcaccacgtcgatgatcatcatttcgcccggtgtcggctgcggtgctgcctgggccggtgtgccgaccacgagagaggcgagcacggcggcgccggcggtcagattgcgaaacatcgtgaatcccccattggattggttgggaaacgcttaccggaaacagtatttccgcatgccgcggcgcccggcgggaatcgtactcaccgtgtttaccggaattcgttgtccgggtgtacccgggctgccgccattcggcccggattccggcatttcgccacgcgcatgacgatcaggtggtatgcgggagcgggtatcgacagaacagcctgctatacaggtcgccctcggagccggccgcggccgccggctgaagcgcaaatcgcccgaggtgcgggtcgccccggggaggctcgggtcgccgctcgggtcgctagccgaggcgttcggcgagcgcggtgtgccggcggccggcgccgaccgtgcgcaccgccgcggccagcgccttgcgcgagccgaccagcaccaccagccgcttcgcccgggtgatcgcggtgtagagcaggttgcgctgcagcatcatccacgcgctggtggtcagcgggatcaccaccgccggatactccgaaccctgcgaccggtggatggtgatcgcataggcgtgggccagctcgtccagttcgtcgaagtcgtactcgatcagttcgtcctcgtccgtccgtaccgtcagggtctgctcctcgggcgacaacccggtgatgacgccgaccgtgccgttgaagacccccgccacccccttgtcgtagttgttgcggatctgggtgaccttgtcgccgacccggaagacccgcccgccggcccgccgctccggcaggtcctcgcgggccggggtgagctgctgctgcagcagcgtgttgagcgcgccggcaccggccggcccgcggtgcatcggggtgaggatctgcacgtcgcggcgcgggtcgaggccgaaccggcgggggatccgctggcacgcgacgtccaccgtgaggcccgcggtctcctcggtgtcgtcgcacgggaacaggaagaagtcgctcatcccgtcgagcagcggcgggcgtccgcggttgacccggtgggcgttcgtgacgacgccgctctccgcggcctgccggaagatctgcgtcagccgtacgcgggggatcacctccgccgcgagcaggtcccgcagcacctcgccggcgcccaccgacgggagctggtcgacgtccccgaccagcagcaggtgagcgcccggcgggatcgccttgaccagcttgttcgccaggatcaggtcgagcatcgaggactcgtcgacgaccagcaggtcggcgtcgagcggattgtcccggtcgaagctggcgtcgccgccgggctgcagcttgagcagccggtgcacggtggccgcgggatgcccggtcagctcggcgagccgtttggcggcccggccggtgggtgcgaccagctggatcctggcgcgtttggcggcggcgagttcgacgatggagcggacggtgaagctcttgccgcagcccgggccgccggtgaggaccgcgaccttgtgggtgagcgccagcttgaccgcggcctcctgctcgggcgcgagggtgttcccggtgcgccggtgcagccagtcgagtgccttggcccagtcgacgtcaccgaagtgcggcatcctgtccgacctgtcgtgcagcagccggaccagggtggcggcgagggagatctcggcacggtggaacgggaccaggtagacgtggtcgtcctcgcggaccacgccctcctcctcgaccagctcatcgagacatcgcgggatgagtccggccgggacttcgagaatcctggacgcctcgtcggtcagctggtcgaccggcaggaaacagtgaccgttgtcggtcgcctgggacagcgtgtactgcaggccggccttcacccgctccggactgtcgtgcggaatcccgaccgcctgcgcgatcgtgtccgccgtcttgaagccgataccccagacgtccgaggcgagtcggtacgggctgttgcgcaccaccgagatcgacgagtcgccgtacttcttgtagatccgcaccgcgatcgaggtggacacccccaccccctggaggaagaccatcacctccttgatcgccttctgctcggcccacgccgcggtgatcttcgcggtccgtttcggacccagcccggtcacctcgatcagccggtccggtgacgtctcgatgatctccagcgtgtccagcccgaagtgctccacgatccgctcggcgaagaccggaccgatccccttgaccagccccgatcccaagtagcggcggatgccctggatggtcgccggcagcacggtggtgtacgagaccacctcgaactgccgcccgtactgcgggtgcgaactccaccagccggacagccgcagactctccccgggctgcgcgccgagcagtgcgcccaccacggtgagcaggtccgatccgctcttcgcggtggccacccgggccaccgtgtagccggtctcctcgttcacataggtcagccgctccagcaccgcttccagcacgtgcggcgccggccgggaggtctgttgcgcggcgggcatggcgaccatcgtgcacggaacgccgggttccgccaagaccgaccctttgtttccgcggacttccgccctagcgtggcgatcatggcgcattttgatctcccgctggccgagttgcggacctaccgttcggccaccccgccaccgcccggcttcgacgacttctgggcccgcaccctcgacgaggcgcgcagcgccgcccgccccgccgagatcaccgaggtcgacaccccgctgcgcgcggtcaccacgtacgacgtcaccttcaccggctacgccgggcagccgatcaaggcgtggctcaacgtcccggccggcgctgcggagccgctgccgatcgcggtcgaattcatcgggtacggcggtggccgcggcctcccggtcgactggctcctctggtccgccgccggctacgcccacctgatcatggacacccgggggcagggcggcaactggcgcggcggcgccaccccggacgtcgacggggacggggccggcccggccgcgcccggctacctgacgcgcggcgcccgctcgccggagaccgcgtactaccgccgcctgttcaccgacgcggcccgcgccgtcgaaaccgccgccgagctccccggcgtcgacgcgtcccgcctggtcaccaccggcaagagccagggtggcgcgctgtccatcgcggccgccggcctggtcccggaccgggtcggcgcggtggtcgccggggtgccgttcctctgcgacatccgtcgcgcggtcaccatctcggacagcttcccgttccaggagatcgtccagttcctgcgggccaacccggaccgggcggaacagaccttcgccaccctcgaccacttcgacgtggtcaacctggcccggacggtgaccgccccggccctgttctccaccgccctgatggaccaggtctgcccgccctccggcgtcttcgccgcctacaacgagctgcgcggagagaaggagatcgaggtcttcgagtgggacggtcacgacggcggccggacctacttcgacactcaggccctcacgttcgccgccacccacctcacctgagccccgccccggccgccccgccccggccgccccctagctagctagccgccccggccgccccgccccggccgtcccgtagcggccgcccagtagcggcagcccggccgcgcccgggcaggacgacgccggcggggacggctgcggatcggcggtgtcggccggggtggtggggtggtggggtggtggcggggcgggtgcgggacgggtcgattcctcaagccggggcgccggcgaccgaccgggtgacttcgcgaatcccggaaccggaggaacatccatgcagccgaccccccgtcgtgccctgcgactcaccgccgtgctcgcctcggcctgcgcgctgaccgggtgtgcggccttcgcctcgaccacggcgaccgtgtcgccgaccgtgtcgcccggtccgaccagcacgttcctgcagaccccgacggtgccgaccagctccgcgcccggcctgtcgaacaccggcaccaacctgccggtggtggtggcctccctggtcaaatacggtcagtggctgatcgcgaacccggacccgtcgctggtcgaccggatcgccgtgccgggctgcgcggccgccaacgacctcatccacgagacccagtcgctggtcgaccagggcgcctacgtgaccacggcgctgccggtggtgaccggcatgcagtatccgtcgccggccgcgtccgccggcgccgcgtcactcggcgatcagaccatgctggacatgcaggtgagccgcccggccgaggccctgacccagcggacgaccgccaagaagacgcagatcatctcctacctgccggagctcaggtccaccacggtccgcgtctcgctgatccggggcgccgacaagaagtggcgcttctgcgaggtcaccacccccctcgacggcagccgcgccgactccatcaccgtcctgctgtaggactccgccggggtcacgacgatgcgccgcccgggtccacccgggcggcgcatttctgtcgggtcggccggcacgaacgctgccgaggccggcgaacggggctcgcggccggcaaaagggggctcgcggccggaaatgggagctcgcggccggaaatggagctcgcggccggcagagggggctcgcggccggcaagcggggctcgcggccggcctcgcggccggcaagcggggctcgcggccggcgcggtcagaggaagttgcgcagcaggctgatgacgaagaagacgatgaggaaggacaggtcgatcgacatgccgccggcgcgcagcggcgggatcaggcggcggatcggggcgaggatcggctcggtggccgcgaacacggcgccgtaggcgcgggatcgcagggagccgggcatggccgggccggccaggacgacactccagtccagcaccgcgcgggcgatcagcaggacctgcacgatcagcaggagcaggctgacgaggccgagaagcatgggttcctccaggtgccggggtggtgtacccactgtgacgcgcccggttgagaactagctgagggaacgctgtggagctgcccggcgacgcggtgcggcgccggcggcgtaccgcgacattgccgatcgggaggaaccggcggtgaccgaccggcgcccggtcgtgaacggtcgtcagaagggataggccggtggttcgtcgcgaaccgtcacccggcgggtctcggtgaacgcctcgatgttggccgccgcgccgccgaagcgggagccggtgccggaggccgcgaccccgccgaacgggctgttcgcctcgtcgctgacggtctggtcgttgatgtgcacgatgccggtcgggatccggtcggcgagggccaggccgcgcatcacgtcccgggtgacgatgcccagcgagagtccgtactcggtggcggtggccagccggaccgcctcctcggcgtcgcggaaccgcagcaccggcgcgaccgggccgaagatctcctcggtgaaggcaggggtgtccggcgtgacgtccgccagcacggtcgccgcatagaacagccgctcgtacgtcccgccggccgcgacccgcgcccgccggccgccgagccggtcaccaggccgtggatcctgtcgcgctgcccggtgtcgatgatcgggccgagcaccaccggctgccgggccgggtcgccgaccggcagcgccgcggccttggcggcgagccggtccacgaagtcgtcgtagagccgctcgtgcaccaggtgccgcccggtcgtcatgcagatctggccctggtggaagtacgacccgaaggacgccgccgcgaccgcccggtcgacgtccgcgtcgtccagcacgatcatcgccgagttgccgcccagctccaggtgggcgcgtttgagatgctcgccggcgagcgcgccgacccggcggccggcccgcgtcgacccggtgaacgagacgacccggaccagcgggtgggtgaagccgggtcatccggtggacgaaagggtgggcgaacgggtggacgaacggcgggacgaacagggggacgcgaggagggtgcggaaaacccgagggtgactcggcggtaacctgcgcgcgtgacccacgagatccagatcaccgcaccggtcgacctgtgcctcccggacgggcgtctcaacccggcggccgtcggctggagccgcaagccgctgcaccgcgccaacctgcgcggctggggccgcaacaagcgctgggagcactggggcgtggtcaccccggcgcacatcctcggggtggtcgcctcgtcgttggactacgccggcgtgcacagcctctacctgctggaccgggtcagcgggcgggagatcgcggtggacgcgacggtgccgctggcccggggcgcggtcctgccggaccgcagcggatcggggcgggtgacggcttccggcggcggcctcagcatcgagatcgcgcaggatttcgacggtacgtcggtgcgggcccgagcccgtgacctggaggtcgacctgaccatgccggccgtcgaggaccgggacgcgctcggtgtcgtggtcgcctggagccgcacccgtttccagtacacggtgaaggacgtcggccgcccggtgcacggccgcctggtggtcaagggggtggagcacatcgtcccggcgcaggggtcccatgccaccctcgatcacggccggggccgctggccgtactcggtgacctggaactgggcggccggcgcggacgcggaccgggccgtctcgctgggcggcaagtggaccgacggcaccggcaccaccgagaacgcggtcttcgaggagggccggctgcacaagatcggcgcggatctgcgctgggagtacgaccgcaccgactggctgaagccgtggcggatcaccggggacggcgtcgacgccaccttcgaaccgttccacgagcgggtcgccaagaccaacctgggtgtgctggccggcgagacccaccagtgtttcggccggttctccggctgggcgcgggcctccgacggccgcaagatcgaccttgacggcctgaccggctgggcggaggaggcccgcaaccgctggtgactagccgagcgccttctcgatcttggcgcggtgtgcccgctcccagtcgtcgagcgtctcggcggcctccttggccagccgggcccgggagtcggtcagcaccgcggcctgccggtcggccgggaccacgacgatcccctcctcgtcggccaccacgatgtccccggcccgcacgctcaccccgccgcagcggaccgtctccccgtgcgtgccgaccttctccttcgtgccggggatcgggatcaccccgcgcgcgaacaccgggaagccgatctcccgcacctcgcccaggtcgcggatcagcccgtccagcacgaacgcggccaccccgcgccggtgcgcgaccgcgcacacgttgccgccggccagcgcgtagtccaggtcgccggactcgaccacgatcaccgagccgggctcggcccggtagatcgcggcgtgcagcatcaggttgtcaccgggctcgcagcgcacggtgaacgccggtccggccacccggggcaccggcgtccacagcgggcgcacaccgatgtccatcacctggccgcggccgagcacgtcggcgagcgtcgtcggggggatctccgcgaaatcgttcatgatctaacgttcccacggcggggggacgcggacgacagccatcccggccgcctgcgccgcacgtacccccagttcggtgtcctcgaaggcgagacagcgggccggatccacgccgagccgccgcgcgcccagcaggtacggctcggggtgcggcttcggatgggtgtagtcgccggcgcagaccagcaccgggaagcggtcgagcaggccgagcgccagcagcgagtcgatcaccgctggccgggtgctgccggagaccaccccgaacggcagtcggccgtacgactcctcgatgtgcgcgagaacgccgggaaccgcgcgcatgctgggcagcccggcccggaacagcgactcctgccgctcggcgaccgcggcgaccggcatgctcaggccctgccgcgcgttcaggtcggcgacgatgtcggcgcacggccggccaccccacgcgtagaacaggtcctgcgggaactcgcactcgtactcggccagcgcgtcctgccaggcctggaagtgcaccggcatggagtcggtgatggtgccgtcgcagtcgaacaggtaggcctggaagtcaccgggcggaaggggtaggagcacggccgaacggtacccggcgatccggcgggacggggaggatggtgttgtgcagatcgcttcggagaccggcgggtggctgcggatgcgaccggtccgctacgagttcgagtccgagcccgacggtccgcgggaggactggctgaccgtcgaggtggcggcggccggccgggacgggcacacctggcagaccgaggtgccgtgcctgctcgtggccgaggcgatcgagctggccggctggctgcacgacgaggccgggaccggcgagctggagttcatcgagccgaacgtggcgttccgccggcggcacggtgggccgggggtggagctgctggaggtgaccttcgcgcaggagacgctgccaccctggctgcccggcagcgggcggggccgggtgcaccggatccggatggaggtcaccagcgaccatctggtccaggcggccggggactgggccgcggagatcgccgcgttcccgccacgggcggatctggcagattggtgagatggatttccgtcgcacgttccgttccgccgcgatcgcctacgccgggctggtcgccgacctcccggccggaagactggacgagcccggtctcggcgactggacgctgcgcgagttgctcggccacacggtgagctcggcgctgcgtcaggtgccgaaggtgctggccgccccggcgccgcaggtcgaggtggccaccgcggagggctatttcgcgtacgcccgctccgcccccgaggagctcgtcgccgccgcccatgccgcctcggccgaggacgcgaaggcctcgggggagctgctcggcgacgatccggccgggcacgtgtcgacgctgatcggccgggccaccgaggcgctgtcccaggtccgcgacgacgacgtgatcaccagcgcggccggcggcatgcgggtccgcgactggatcccgacccgcaccttcgagctggtggtgcacgggctggacgcggcggcggccaccggcgtggagttcgacctgccggtcgaggtgctcgccgagtcgctgatcctggccacccgcaccggcctgggcatcggcgccggtgtcccgctgctgcgcgcgctgaccgggcgggagcagctcccgcccggcttcactatcgtctagagcacctcggcggccatcggcagcgggttgccgaagcggtgcgcggtgatgctgaccgcctgctcacgcaggaacggcagcagttccacctcgccggcctcgaccaccggcccggcccacacggccaggtcgggacgtccgccggtggcggtcgccaggtcaccggccgagccgccgatcaggcgtacccgcgagaccccggccagcccggccgcgaacgcggcgtccggctcgaccgtggcctccgggaacagccgcgtcgcctcggctgtcgacacctggatcggcgccccggcgagcttcgccgccgcgacgacgcggaccaggccggcgagcggggcaccggccgcgaggcggacggtcaccggggtgggcaggtagcgcagcacgttgcgctccacgcccagcgccgacacgtcctcggcgcggccgaacgacgccgcccaggccgccgcgtcgctgcgcgcggcacgggtcaccgacgccacctcgtcggcggtgaggtgcgccgcggcggcggtgagcaacgtgcgtaccgccgcattgtcgatgtcggtcgaggccgtcgccggagccggcgcccaaccgctcaacccggtgaggtagtggggcccgccggccttggtgccggcgccgaccgcggacttcttccagccgccgaacggctgccgccgcacgatcgcgccggtgattccccggttgacgtagaggttaccggcctggacccggtccagccaggtgcgcacctcgcccgcgtcgagcgagtgcaggccggaggtgagcccgtagtcgacctcgttgaccaggtcgatcgcctcgtccagggtgtccgccgtcatgatcccgaggatcggcccgaagtactcggtgcggtggtacgccgagccgcggcggaccccgtcccggatccccgggctccacagctgtccgctctcgtccagcttgcgcggcgccagcagccagctctcgccggcgccgagcgtggtcagcccgtcgagcagcttgccggcggccggctcgaccagcgggccgacctgggtgcgcggctcggtgggcgggccgacctccagcgaggagaccgcgtcgagcagctgggtgcggaaccgggcggacctggcgaccgagccgaccagcacgaccagcgaggcggccgagcacttctgcccggcgtgcccgaacgcggacgagaccacgtccttgacggcgaggtccaggtcggcgctcggggtcacgatgatcgcgttcttgccggaggtctcggccagcagcggcaggtcggcgcggaacgagcggaacagctcggcggtctcgtacgcgccggtcaggatgacgcggtcgaccagcgggtgggcgaccagctcgcggcccagcccggcctcgtcgacctgcagcagggtgaccaggtccgggtcggcgccggccgcggccagggcgtcgcggacgatgccggccagcacggcaccgcagcgttcggcgggtccggccggcttgagcaccaccgcggagccggcggccagggcggccagcatcgagccggccgggatcgcgaccgggaagttccacggcggcgtgaccagggtcagccgggccgggaccggggtggcgccgtcgatctgccgggccgacagctcggcgtagtagtgggcgaagtcgaccgcctcggagacctccgggtcggcctggtcgatggtcttgccggcctcggccgccatcacctcgagcagcaggtcgcggtgcgcctccagggcgtcgccgacccggtgcaggaccgcgcggcggtcggcgccgccccaattcgcggcggcggccttctccagggtggtgtccaactcggcggccgagtcgatccggcgcaggtcgagacccagccgggacgacggcacccgggccagcaacgatcgcatccgggtgcggttcgaggccaccgccgggtcggtgtccggggtgttctcgaagtgccccggcgccgaatgcggcaccgccgcgtaccggtcggcgacccggtgcgccgccggcacggtgtcgtccaggtccgcgagggacgcgaggaagcgctgcttctcccgctcgaacagcgcactgtcgtggtgcagctcgaacaccgcggacatgaagttgtccgagctggcgccctcctcgaggcggcggatcaggtaggcgatcgccacgtcgaactgctccggccggaccaccggcgtgtacagcagcagcccgccgacgtcccgccggaccgcttcggcctggccctcggccatcccgagcagcatctcgaactcgatgccgtcgcgcaccccgcgctgcccggccagggtccacgcgtaggcgacgtcgaacaggttgtgcccggcgaccccgacgcgcacgttgcggatccggtcgggatgcaacgcgtaccgcagcacccgcttgtagttggtgtcggtggcctgcttgctgtcgcaggtcgccaccggccagccgtgcaccgccgcctcgacccgctccatcggcaggttcgcgcccttgaccaggcgcaccttgatgtcggcgccgccgcgctcgcgccgtgccgcggaccagacctgcaaccgcatcatcgcgctcagcgcgtccggcaggtaggcctgcagcacgatgccggccgacaggcccagcaggtcgggccggtccagcagccgggtgaagaccgcgacggtcaggtcgaggtccttgtactcctccatgtccaggttcacgaacttgccggtccgcgcggccagggtgaatagggggagcagcttctcggtgatgtcgtcgacggcctcgtcgaacgcccacgggttgtgcggcgccacggtcgacgacaccttgatcgacacgtagtcgacgtcggggcgggccagcagccgctcggtctcggagagccggcgcgaggcctccccccggccgaggaccgcctcgccgagcaggttgacgttgaggcgtacgccgcgcttgcggattttgcggatggcgcgaccgagccgcctgtcggtggcgtcgacgatcaggtgaccgaccatctgccgcagcgcccgccgggccagcggcaccaccacgccgggcatgatcggggcgagcgcgccgcccagcttgaccgcggccttgaggtgggcgggcaggaacgccgggacgtcaccggccagcgcgttcagggcgcgggcgctgacccggcggtcctcgggacggaccacgccgtcgacgaagccgaccgcgaacgcgagccctttcgggtcgcgcagcaggccggccaactgtgccgccgagccgccgaccgggacggtcgcggcttcgcccagccatcggcgcacgagggcgatcgtctcttcggcgatctcagacatcgggatgctccttccggtttcagcttgagtctgcggtccggcatccggttaggaaaagcgatgcttagtgattggtatcgttaagctgcgctaacgtatgcggatgctggagatccgccgcctgatcctgttgcgtgagctggccatccggggcaccctggccgccgtcgccgaggcgctcaacttcaccccgtccgcggtcagccagcagctcagccagctggaacgggagaccggcacggtgctgctgcgcaaggccggccgccgggtccggctcaccccgcaggccgaggtgctggtcgcgtcggtcgacgaggtgctggacaccctggagcgggccgaggcccggctgcaggcggcggccacccgggtcaccggggcggtccgggtggcggtcttccagtccgcggcgctcgccttcatgccggccgccctgcgcctcgcggcggcccggtttcccgacgtacgcgtcgagatggtccagcgggagcccgaggaggccctgcgcgagacttgggcgcgggacttcgacatggtcatcgctgagcaataccccgcacacgcggccccgcaccatccgggcctggatcgccgcgatctgaccaccgacgcgatccgcctcgcgctgccggccgaggccgagtcgctgcacccggtcgactcgctggacaccgcccggcacatgccgtgggtgatggagccgcgcggggccgcctcccggcacttcgccgagcagctgtgccggcgggccggtttcgagccggacgtccgctacgagacggccgacctgcaggcgcacatccgcctggtggagaccggcaacgcggtcgccctgatcccggacctggtctgggccgggcggacgccgtcgtgccggctgctggcgccggccgggagcccgcgccggaccatcttcaccgcgcagcggttgtccggggccgagtccccggccgcccgtgccttccgcgggctgctggaggaggtcgtcctcacctccgcgacgggtccggcgccggggccgggacgctctgcgccgggcacaccgcagcgatgaaggtggggtgcgcgccgttggtgaaccggcagccgaacgagtcggcggccacctgccggcggtccaggatcgcgtcgccggccggccgctgcccggtgcgcacccagcgggtcaggtcgtcgaagccctgcgccagctcggcctcggtgaagtcgcagtgcccgacgccgcggatggcccgagagacgaacagcccggcccggccgttgcgggcggcccgcagcgcgtagtcctgctccatcgcgaacgggacgaacaggtcgccgacgtcgtgcagggacagcaccgggatggtcggccggccctccacccgcgggatgccggacagccccgggtcgccggtcgcggtgtgccgcacccgcagcacgtcggcgttgagccgcagctcggcgaagctcggccaggggtagtcgtcggcccggtagaaggtgaactggttgtcggtgacgttgccgggcgcgatcccgccggtgccaccggtcaggcccgggtagaggccgaacaggaacggcaggtcactcagcggagccagcgatggcgccgcgttccagtaggcgaaggccgagtcgaagccgggccgctcgccgccggtgcgccgctccaccacgtcggaccagatcttcccggccggcgtgagcgccggagcgctgcccaccttgacgccgagcgccgcggtgatccggccgacctgggcatgccactgcgccgggtagtcggcggccggggtgagcgggaagtcgatcttcactctggccagcgccgccgcggtcacgttcgcgtccaggaagtagtcgtagagcctggtgtcgccgagcacgccgcagtacggcatggccgccgcgaaggcgtgcgggaaccgttcgatcgccaccgcggtcacctggccgcccatcgacgcgccgctcatgatcaccgagcgggcgcggtggccggtggccgcgcggaaggtgtcgatcatcgcgtacgagtcgcggacgccctggcccacgtcgtacccgttggtggcgtagctggaggcggcccacgcgtacccggtctgcaggtagtgcgcgcgcagcgcggggttgtcgacgtagaccacggtgccggtgccgcggtagccgtgcgcgtagacgaccagcttgccgttccaccgcagcggcacctcgacccggtacgccgcgccgtcccggatcccggtgtagatcttcgagatcgcctttccggacgcgtcggtgagcggggtgaacggcgccccggagacgtcgcaggccgggtcgaagacgaggtagccggggtgggtggtgctgggcgtcggcgccgcgcaggtggccggtgcggcggaggccggcgcgctcagcgcggtgaccagggccagtgcggcggcggcgacggcgaggcacttctggcgcatggtcatcgtgttacctccgagacacatgaaaggtccggggattgacgtttgtcaaggccgccacaacttttcggacagtgccccgccgtcgatgggagtcaggccgcgcgcagccgcaccgcgatggtgtcaccgtgggtgaccaggtcggcgcggaaggcgggggtgtcgacgaccacggacgcgaaccggccgcgcaggcaaccggccgtcaggaccgggatcggggcatcgtggcgcaacgccggcggcaccgcgatccgcagcgtgccgcccaccgtggcgtcgccggacacggtcagcgccggcttgccctccgggtcggcgacgaccgcgaggacaccaccgctctgccggtacgacccgtgcaccgtgacctgtccggcgaccaggacgccgccggacacggtcacgtcgccgcggcccagcgcggtgggggcggccgcgaccagggtgccctgcgcgaccgtggtgccgccgcggtagtcgttgtcgccggacagggtcagcgtgccgctgcccagcttgaccaggccgccccggccggcgatgtcgttgcgccaggcgtcggccgcgtggaacccgccgagcgcggcgtccagggtgaccgccacggtctggtcgaacgcgccgtaaccgtcggcggcggcgaacaggttcagccggccccactgctccgggccgtccaggatcgggtggcccgaagtcaggccggtggtccggagcacctcgcggcgctgcgcggcgtccaggtagggcagccgggtctccagcagcacctcggcgccgtccgggacggtcaccgggacccgcttgccgtgcgccggcaggtcgtacgtgtgcttgtgccgcacgatcgccgcgttcgccttacggtcggcggggtcatgggcgtacccgaagagatcccgggtgccggtcttctcctggaagtaggcgagcgcctgggcccgcgcctccgccttgatcgtcgcgttcgccgggtcgcgcaggatcgcggcggccagcgcggtggccaggatccggccgccgatcacgtcgaccggtgagtgcatgccggccacgatccgggtgtcggccaggtcgtacgccgtggtgaccagctcctggaagcgctccggcaccgcgtacgcgtaggccagcgcggccaggaacagcgcgttggtgtgcccgctgacgtagccggcgtcgtcggccgggctggtgctccgctggcgcagcagcgccggcgccaccttgaccggcgagtcgtagaccgggtagccgaactcgtccaccgcgccggtgtcggcgacccggctctgctcggtcagccgccacgggcgcgggtactggtaggcgtacttcgacgggttgcccgaggagtagttgccgcgcagcgtgttgaccagggtggcgaccttgccgagcgccgagctggtggaaccggcgccggtggccgcgccggccggggagccggccgggaccgagtcgctgatcgtgccagccggggtggtggccggcgccgaggtgatgctggtgaccgcgagcgcgccggcccggtacagatcggcgagcgggccgaggccggcgatcaccgagtagctctggtgctgccggtcgacgaggaacgccttggccgcctccgcgtcggtgcgctccgcggtgaccctggtgacgtagcgcatgctggcgcgcaggaacgcctcgtccagcacggtgccggtgttccaggcggcgccggtggcccagaccttctggaagccggacaggatgcggaccgcggcgttggtgtcggtggtcaggttcgcgatgacgttcgtccggtagccgtcgacgaagccggtgccggtggcggcctcggccggcagggcgcggagctgggtcgcgagcagaccggcggcggacgccttgaagattgtccggcgggagatcatgggcatgccgagcagcttcggtgcgcgttccggccgggacgcgaacacccgcgagtgttagcgtgaacatcatgctaccgacgagtagccgcggtttcttttcatcgatgatggccttagcgtcgcgctcgtgtacaagacagccttgctggccgccttgcttgcggtccccgccgtgatccccgcacccgcagctgccgctggagccaccggtggcactctcaagattctttcctacaacatcgccgggctccccgacatcctgtccagcgccgacaccgaccgggccacctcgactaccgcgatcgggtcgcggatcgccggatacgacctggtcaacgtgcaggaggacttcaacttccacgcttacctgtacgccgcggacacccacgcctaccgcaccccgaccagtggcggggcgggcatcggctccggcctgaacaccctctcgaagtacgcctacgacaccgacgacttcgagcgggaccgctggacctcgtgccagtacgactccggtgactgcctgacccccaagggcttcaccttccagcgggtccggctggccgagggcgtctacgtcgacgtgtacaacctgcacgccaacgccggcaccaacgccggcgacctggcctcgcgcgccgccaacctgagccagctgaccaccttcatcggcagccactccccgggcaacgcggtgctggtgttcggcgacaccaacacccgctacacgcgggacggcgacaccatcgccgacttcgtggcgaacaacggcctcaccgacgcctgggtcacgctggagcgcggcggggtggccccggccaagggcgcggacccgatcctctgctccgacgactcctgcgaggtggtcgacaaggtcctctaccgcggcagcaggttcatcacgctgaacgccaccgcgtaccacaacgagcacgccgcgttcctcgacgccggcgggctgatgctctccgaccacgacccggtcagcgtgaacctgaactggtccaccaatcccgcgtaccagttcagcgaacagttcggcggcccacacggcgactacttcgacgacgtcgacacggccggcccgctgtcctcgatcagcctgcgcgccggatcccgggtggaccggatcggcccgcacggcgggaccggcggcaccctgaagacgctgaccctgggcgacggcgagtacgtgaccagcgcccaattgtgccgtggcgtgtacaactcacacaccaggatcttctccgcgaagttcaccaccaaccggggcaacaccctggccggcggcaccaccaccgcggactgtgtcacccggaccgcgcccaccggctggcagatcgccggcttccacggccgggccggggacgaagtggacaagctcggcctcatttacaccaggcactgaccgcgagcagtgttggcggagcccggggtgggtaccccggctccgctgacacctgcgcgggaggcctgagatgtaccaagcggcggcaccaccccggcggcgcacctggctgcgggtcttcctcaccgggctgctgctctggctgctcaccgtggtggtcaccctggtcaccggcaacccgaacctgatccccacgctggtgctgctgggcagcttcctggtgccggtcaccttcgtgctctgggcgttcagccgccggcacagcggcgaggtcaccgccgagctgctgttcagcacgttcatcaccggcggggtgctcggggtgctcgcggcgtcgctgctggagacgtacctgctgcacccgtccccgggcttcttcctcggcgtcggcctgatcgaggaggcggcgaaactcggcgcgctggcgtttctgacccgccggctccgccacaagtacgccgccgacggcgtggtgctgggcgcctcggtcggcttcgggttcgccgcgttcgagtcggccggctacgccttcaccgcgctgttcaccgagcgcggcctgtcgctgatgcagctggtccagaccgagttgctgcgcgggctgctggccccgctcgggcacgggctgtggaccgcgatcctgggcggggtgctcttctcggccagcgggcggcggcacttcgcgatgacccggcggctgctgtcgtcgtttttcggggtggccgtgctgcacgcgctgtgggacagcatgcacagcatcgcgctgctggtcacgctggtgctgaccggcacgccgtaccagtattcgctgctgcagcggggctacgagccgcagccgaccgccgcccagacgcacctgttcaccctgctgtcctggggcgggctgatcctgatctcgctgatcgccctgctctggctgcgcgccgtcgcccgccgagccgatcaggacggtcgatcgctgtggcgcattccggtgggataggtctacggtccgatgcggaggttcgcgcatggatgatcccgggatcgcctacggatacggccggcaccgcggcctgctggtggaccgcagcggagtcgaggagatcgtcttcggccgggtcctgctctacctggagaaagctgacaccgacctgatcaacgccttggccgcgcggctgtccggggtgatcatcgaggagccggtcacgccgtacgcgccggaggcccgcgcgctgtgggcgctgcccgtcccggtgctcaccggagtccgggtcgacgacagctggctgggtcacgaggtggtcgtcgacttcgacgcggccaccaccgcgccgcccgccccggccaccgccggcctacgcctgcacgccgaggtgtccagcccggccgaggcccgcgacgccgggcacctcgccgacggctgggcgccgctgcgcgccgacgatctagctagctaggggcgccgctgcgcgccgacgatctgcgcgcgctgtccgccgccgaccgcgaccagctctgggcccacctggccgactccggccgcccgctgcccgccgtgcgctacttcgacgagccggccggcagcccaccggccgcctccttcggccggcgcggcgtccgctccccgctcccggaagatcttgatttcctgggtacggtgatagcggcgtcccccctcgacgatccgctggtggtcctcccgatggtcgccgtgcgcgccgagatctccgccttcgcggccctcgccgacccggcctggcgactcggcctggacgtggccaccccggccgccgccctggccgtcgccgacctggtcgacgactgccacctgctccggatcagcagcggcgacctggcccagcacaccctggtctgggaccgcagcacccgcaacgacaccctgctcccgcccgaccggctgcccaccgtgatcacccagctggtcgagtggtcggcgtcggtcgcggcgacccgctcgatcccctgccaggtctcgatcgacctgcggcccaccccgcagctgcacgaccagctgcgggccgccggggtcaccgagatctcctgcccgccgccgctgatccggcactggcgtcacctgctcgaccgctcggtctgagcgcggcgggcggcttccgcgcgtaccaccgcaagcgcggccggaatcggccgcagcccaccgccggacagcggtcagcgcccgccggacagcggtcagcgcccgccggacggcggtcagcgccgctgggcccggtcgaccagctcggcggcgacgtcgcgcagcttgcggttcgactcctgggaggcccgggacaggatcgtgaaggcctcgtcggcggtgcagtgccgctggcccatgatgatgcccttggcctgctcgatcaccgcccggcccgccatcgccgcctgcaggtgcccggccagggtcaccgtggtgtcgtacaggtgggcgttggccagcgccaccgcggcgtacccggcgaacgtctcggccagcaccaccgcatcgtcgtcgaacgcctccggcgtctcggcgtagatgttgagcgccccggccacccgttcccggatcggcaggccgacactgagcgcacagttcaccccggcgtcggcggcccgctcctcccagccgggccagcggcgctccgtgcgcacgtcgccgaccagcagggtgaggctctgccggcaggcgtccaggcacgggccggaacccatttcgtactgccacttgtcgatgtggtcggcggccgggccggtgctcgccgcggtgtgcgggccccggtcgcgaatcagggtcaccgacacctcgtacgcgccgggaatgctcctcttcgccagatccgcgaccgtggccaggacgccctccagatcggtgtcaccgagtttgatccggctcagctcgcggaaggcgaccgtggggtccatcggttcctgcgtcatggttgccgcatacccgtttcacgccgcgccgatcagcggagcaccgccggctctgtcaccggctagggtgaggacgggtcaagccacgtgcccgtgccatcgcctgccgacggtgagggatgccgcgtgcccgtcgaacccccgctgaccgtgttcttccgtcacctcaccgccgactccgccctgctgctcgtgcagggtgaggtcgacgcgggcaccgccggtgtgctgaccacggcgctgaaccacgccgtcggcgcctacccgctggtgacctgcgacctgagcggggtcaccttcttcggcgccgagggggcgcacgcgatcgcgctggcccgcgcccgcggtcacgcgcaggggcacgtcctggagctggcgggcgccccggcgatcgcccgggacgtcctgctgatcgccggactcggcaccatgctgcgaatctccgggtgagtttcggtatcatcgacgtcctgcggccgatgtcgggcacgacatcggcgaaccagcgtcaagcagcggcgcgggaccgagagccttgcggctctccgggcagcgacaccggctaacccagagcgagtcgccaccggcggcccgccgctccgctgcggggaaacacagacgttgatggcgcacgaccggcccgaatcagccgcggccttcacggaactcggccgcatcaagctcggtgagaccgatctcaacggcgtcctcgaccgggtcgccgacctggcccggcggaccctgcccggcgccgggcaggtgtccatcacgttggtccgcaacagggccgcatacaccgcggcgcagaccggcgagagcgcgctgcggctcgacgagcggcagtacgcccaggaccgcgggccgagcctggaagcggccgccggcaagaccaccgtgcacgtcccggacaccgccaccgagccgcgctgggacggctggggcgagcacgccgccgcggccggcatcggcagcgtgctggcggtcgggctgccgatcgtggagaacgtcagcggggcgctcaccatctacggcgcggcggccggcgccttcgacgaggcggcgatcacgctggcccagacgttcgtccggtacgccgcggtcgccctggccaacgcccacctgtacgacaccacggcgacgctggcccagcacatgcaggcggcgatggcgggccgggcggtgatcgagcaggccaagggcatcatcatgggggagcggcggtgcaccgccgacgaggcgttcgccatcctcacccgggtgtcccaggattccaaccgcaaactgcgcgacgtcgccgccgccctggtcgagcgcacccagcagcggggctaggcggtcacgtccaggcggttgccgtcgtcgcgccgggacaggtggcgcagggccggctcgagatatccggccaccgggttacggccggtcccgccctggtcgtaccgccgcgaaagatctttgaggtaggccgcggtcacctcctgaccgggcgccagccggccggccgcccggtccgccgcgatcgccgccgccagcgagttgatccagccggcgttcttcgggccgtccccgatccgctgaccggtggcctggtagatcagttcccggtcccggtcggtgagcgaagcggcgtcgtcgcgcgcgttctggtgacgttcccgggcggacggccggaccggtgtcaccgatggcgtctgcagggcacggttcaaccgggaaacggacatcgggccggaacctcctgggcactcgtcctcctccagatcggccgcccgccacggcacctgaggacgcgtacggtgggatctgactccccggatcgcaggccgcgccacggccgcgcagaaagggacgaccatgaccacctggaccaccacggaacggatcgacctcggcccggtgcggctggaggccgacctgaccctcaccgaacacgccaccggcgtggtgctcttcgcgcacggcagcggcagttcccggcacagcccgcgcaaccgtgcggtggcccgggagctgcaccgccgcggcttcgccaccctgctggccgacctgctcaccacgcgggaggacacccggccgcaacggttcgacatcggactgctcgccgaccggctggtcgggctggtcgactggctgcgcgcccagccggccaccgcgccgctgccgctcgggcttttcggcgccagcaccggcgcggccgccgccctggtcgcggccgcggcccggcccgaggcggtccgctcgatcgtcctagctagctagcgctgccccgcggcggcctgccggtcgccgcgccgatcgcgctgcggctcggcgccgagttggacatcgtggtggtccgcaagctgggtgcgccgggccgcccggaattcggcctgggggccgtcgccgaggacggcccaccggtgttcgacccggacaacctgcggtatgccgggctcaccgaggaggcgatggacggcaccctggcggtcgagcgcgaggaactggcccgtcgggtgcgccggtaccggggtgagcgcccggccccgcgggtcaccggccgggtcgtggtgctggtcgacgacggcctggccaccggggtgaccgcgcgggccgcgctgcgctgggtccgcggacgggcgccggtgcggctgctgctggccgtgccggtctgcgcacccgaggcccgcgacctggtggcgcggcaggcggacggggtggtgtgcctgagcgcgccgccggaattcttcgcggtcgggcgctggtaccacgacttcggccagctcaccgacgaggacgtggacgccgtgctggatagatttcatcatacgttgaaatagcctctcgaccgcggacgggaattcatctagcgttgagttcaacacttgatgagttcttgggaggaaccatggacaccgcgatcgaggtccacgacctcgtcgtccgccgcggccccaggacggtcctcgaccgcttctcctgcgccgtcgcgcgcggcagcgtcaccggcctgctcggccccagcggcagcggcaagaccaccctgatgcgcaccatcgtcggcgtgcaggtggtggccggcggcacggtcaccgtcctcggcagcccggccggcgcccccgccctgcgccgccggatcggatacctgacccaggcgcccagcgtctacgccgacctcaccgtccgggagaacgcgcgctacttcgccgccctgcaccggctcggccgcgacgccgccgaccgcgccctcgaaacggtcggcctcaccgccgccgccggccagctcgtcgccgacctctccggcggccagcgcagccgcgcctcgctggcctgcgccatcgtcagccgccccgaactgctcgtcctcgacgagcccacggtcgggcaggacccggtgctgcgcgacgaactgtgggcgcacctgcgccggatggccgccgacggcgccaccgtgctcgtctccagtcacgtcatggacgaggcgaaccgctgcgaccggctgctgctgatccgcgacggcacgctgatcgccgacgacaccccggccgcggtcaaacggtccgccggcaccgacgacctcgaccaggccttcctcaccctgatccgcgcccacgagagggtgtcggcatgatcctgctcagcaccatccggcggatcctcacccagctgcggcacgacccgcgcaccctcgccctgatcgtggtcgtgccgaccctgctgatcacgttgatctacttcatgtacgacgggcagccccgcgccttcgaccgcatcgcgctgaccatgctcggcatcttcccgttcatcgtgatgttcctgatcacctcgatcgccatgctccgggaacgcaccagcggcaccctggaacgcctgttcaccaccccggtcggcaaactcgacctgctcttcggctacggcatcgccttcggcgcggcagccgcggtgcaggcggcggtcgcggccggattcgcctactggatcctcggcatggacgcggccggcggactcggaccggtcgtgctgatcgccgtcgccaacgcggtgctcggcgtcgcgctcggcctgctgtgcagcgcgttcgcccgcaccgaattccaggcggtgcagttcatgcccctcgtggtggcgccgcaactgctgctctgcgggctgttcgtgccgcgcgagcggatggtggggtggctgcaggggatcagcgatgtgctgcccatgtcgtactcggtgcaggcgctcggcgaggtcggcgtgcacccggagccgaccggcacgatgtggcgcgatctgatcatcgtgctgggcgcgatcatcgttgcactcgggctgggtgccgcgacgctgcgccgtcgcacgagatgatggcggcggtacgcgggtagccgccccgctgtggcgaccccgccccggggctggtcgcgcggggcggtcggcggcggtcgcacgctgggggtgcgcgcgtaccgtcgtagcgcgcgccagctacgtacgtacggggagatgaggttttccatggcacgacggaccgggcggcggcccggcaacccggacacccgcgagtcgatcctgaacgccgcccgggaagcgttcgccgacaaggggtacgacggggcctcgatccgtgtcatcgccgccggcgccggcgtggaccccgcactggtgcaccactatttcggcaccaaggacaagctgttcctggccgcgatgcaggcgccgatggacccggtggcactgatcgaagccgccaccgagggcggcccggacgaggtcggcgaccgcttcgtccggctcttcctgcggatctgggacggtccgggcggcgcggccggcgtcgccctgctgcgctccacggtcggcagcgagtggaccaccaaactgttccgcgaattcgtggtcacccagatcctgcggcgcgccgtgccccgcctcggcctcgacgagaccgaaggccggctccgggtcaccctggccgccagccagatggtcggcatcgccatggcccgttacgtgatcaaggtggagccgctggcctccgcccccgccgaggcgatcgtggcggcggtcggacccgccgtgcaacgctatctgaccggggagctgccgggcgtcttcgcatccggggaagccgtcggaccctcggcgtagcgtccgggggcgttctattcttcgccgggggcggcgcccagcttggtcaggtaggtgtcgatgtcgttgcggacgctggtcggcaggtcctggaactgcaatccgatctccatctggccgtcccgcggcgtccggcgcatcaccttggcgtcaacggccccgcccagtccgtcgaagctgagctccgcccggatcacatcgccgatctgcaccggaatgtccgctgccagcgtgcacccgagcccctcggaactgaggtccaccatgttcgcggtcaccggctgcggccgggacggcagccgcaaccgtaccgtcccctcgatcgccagccggtcgtgccgccggcgttccaggcgttcggccacgtcggacaggtcgccgatctgcgccatcgtggcgtccacactggcgtgcagccgcatcacgatgtcgtgctgccggtcggcgatccccccgagctgacgcatcgcgtcctcgatgtccccgacgtcgtgaatgatggcgctgagcgtctcgcccatctgcgccacgtccgcctccagcgcggcgatcgtgctggtgatctgttcggtcgagtccgccgtggtgtccgccaggcttttcacctcgtccgcgaccaccgcgaagccgctgcccgccgccccggcccgaaccgcctcgatggtcgcgttcaacgccagcagccgggtctgcgaggcgatcccggagatcacactggcgatcccggccacctgccgcaggctggcgttcagcgcggtggccgcctcgtccgcactccgcgcccgccgcaccagcgcctcggcggcatcgttggtgtgcgacacccgctcatgggtggccgccgccgcctgccgcgccgcccccacctgcaccacgacgtcttccagcttcccgccgatcaccgcggcggtgctgtcgatcgcctccttggcccgccgccgcagcgtctgctgctgctgtttctgctgcaacccggccgcctgcgcctgggccgcccggtcctcttggagctgttccagctcactgtcccgggcagccagcgccgccgacagctccgcgatcctctcccgggccccggccagcgtctccgggcccgagccacccccggctccgaaccgcccccacaccgtgccgtccccgccgccgggcccacgcccgcgcagcgcccacgccgcgccggcgcccagcacggcaagcgcgaccaccagggagatcatgagccacaccggcatcacgccacggtgacggcgcggaaacgctcgggacgcgccgacaaacccacggcccctcccgcacgcactcggtactcaccagacgccccgacgctacccgaccaaaccgcccgatgtacgcacttcgcctaccccacgccgccccggcctccctgcccccatcccgccctgtgccgcttcacgtcgctgacccccgcgccctcccgccaccccggggtcgtcctcgccaccttgcatgacaccgctccgcatcgtgcgggttgcatcgcccgaccccgtcgccttggccgctcggtgcgccggggtggcaggcgcgttgcggaggcgagtgaaaagtcgtgtggggaaaagctcaactccgtgatcgcctgccgatggtcggggcctcgcgaagatcaaggagacgacatgaccatcagcatcggcacttcgacgcagtcctcggcctgggagacgcacgcggcgtggttgcggctccggggcgactgtcagcaactcttcgaccatgtggtcgccggcgcgaatcggcgggaactggaggacgacaaggtcgccgttctggagagccgtgatgtcatcgcccgcctggaaccgggcagcggcgtcaacatcctggtctgaccaggtgcgggagtcacgcgcggcaggaatcggtggtgaaaccggccgtgacagcaggcggctgcacgagtcacatgcgaccggaagcgggcagaccggcggttggtcggtcgtcacacgggggacagcagtgcggaggcggtggcagccggcagggtgaagcggaaagtggaaccgccgcccggatcgtcggtggcggtgatctcgccgccgtggcgttccacgatgcgtttgcagatggccaggcccggtccggtgccgaggtagccgtcgccggcgtgggcacggtggaagttgccgaagatggcgtcgtgtcggccttcggggatgccgatgccgttgtcggtgatgcggaccgtcaccatgccgtcggaggcgtccgccgagatctggaggaccgggacgactcccggcgcggtgtacttgatggcgttgccgaccaggttgtcgaccagttgccggacgagcaccggctcggcctgtaccggcggcaggtcaccgatggtgaaccggggttccggcttgccggccacgaccgctgcgtcggcgcgggctccggtgatgtcggcgacgatctcggccaggtcgaccgggaccggggcgaccatggcttcgcgggccgtggcgtacgccagccaggccggcgaccacgccgacgtcggccggtgcgtcggtgagccagttgccgacgccgaggatcacggccaggagcagggtgtcgagtcgccgggtcggcgcggcgcggtgggcgccgaaccagaccaccgccaaccggccgccggccagacgagactgacgccgtcggcgaccatcgcggtacgtcgtccggcgtagaccgcggcggcatagacaagggcgaagagcgcggtccgggccagcgagagccggtagccagtcgtcacccgccacctcccgcccgacgtctgacctagccttatcggcccggttccgccggcgctgagcgcgggacatccgccctgttcaatgctgattccgttcgtccggaaatcggatcgtcgcgctcagcggaccgacccggaggatgccgtcgttcaacggtacgcatcgcacgccgccgcggccgcgcagcgctttccacgccccggggccgatggtcacgtccatccaggcgcacgggttggctcgccggcgcaccgacaggtggaccggcccgtccccggagtcgagggtcagcgtcgccccgaccagatcgtccagggtcaggccgcccggcgatccgcccgcttggacggcgggcgatcccgccgcggtcgggccgggcgaatcagccgcctcgggggcgggcgatccgcccgtgtcaggcgcgggcgatcgggccggggccccggcgaggcgcagtccggcgacgaggatgttgcggcgggcctgcgccagtccggcgcctgcgggcagcgactcgcgggcgatcacggtgatcgacgcgtcccggtgcgcgggatggttgaagtagcggtcaccgacgatgccgagccccgcccggatccggatctcgccgaccgattctccctcgggcgccggcgcgggcccgtccgcgggtcgcccctcgaaccggtgcaccggcgacgccagcagttccacgatctccaccgcacgaccctatgtccgcgcccgggatcatccggccgctagggggttcgttctcggtgaccgcccgtgcccgggagcagcggtcagttatcggccgcggcgcacgacatgattgatttgatcttcgaaggtggtctgccgatgtccggtcccgatcactggatggcggccagtgcctcggccagcacgtccttggcgtcgtagacgtcgacctcgcgcatctgcagcgggccgccggtttcggtgaggcgtgcggcttcggggccgccggcgaagaacggggcgaagccgagttcctggatgatccggcaggccgcctcgcgggcgtcgcgctggttggtgcagacgaattcggcgaggagcgggtcgtgcccgcggcgacggtcgaggacctcggtggagatcgtgttgaaggctttcgcccagtgcgcctcgggcgcccagtcgatcagcgtctcgaacccgctcttggtggaaaagcccagctcgcgactcgtaccgggattgtcgggaacccggacgaaggccgggatctccagcgccgacgggaagccgggggcgaacgcgccgaggccgcccggcccgggtgcgccgggcatcatgccctcggtcggcgcgctcatgaacgacgggttggtggcgtcgatgaccaccttgccggccatcgcgtcgtgcgcgatgtcgatcgcttcgcgggccgagtcccaattcggcgcgaagaacaacatctcgccgaagacggccgcttcggggatcgtcatcgcgcggatgtgaccgtcgccgtgctcgaccaggtcggtcaaccggtccggatgccgggaggtgaccgccacgtcgtgtccgctttcggcacaccatgttgccagagtgccgccgagctgccctgccccaatgacaccgattcgcatgctcccagcgtgcctggtggatcactcggacgcgtggtgaaccgggaaaacgccgtacatcatccgcagctcgacggtgaccaggtggtcgaccagcgcttgcgggtcggtcgcggcggcgaatgcggcggtgcgcaggtcgtcgatgagctcggccaggatccgcgccggggggccgtccggggcgaggccggcggcgcgatcccgggtgatccgggcggcgagcaggtcgacatgtgcctcgcgcaggcccgcccgccaccgggcgatcggcgggcagccgggggcggcggcgagcgccccggcgatgagccggccctggtcacgccagaggacggcgagggcggtgagggagcggcgcagggccggcgcgtccgggccggtgccgtcgagccaggcttcggagtcgcggccgagctcgccggccagtccgtgcagcagcgcgacgacaacggccagcttggagtcgaagtagaagtagaaactggatcgggagatccgcgccccggcggccagctcgtcgatggtgatctcggcgagcggcttgcgggtgagcaggtcgcgggcggtgtccaggatcgcctgctcgcgcaggtcacccttgctcgggctgcggcggcggggggtcatgtgaatcacgataacgcgctgtccagtattttcgacgtagtgtcgattccaagtttcccgacgtcacaggagcgttcgatgcaggagatccgccttgccagccggcccaccgggtggccgaccgccgacaacttcgagctggtggagctgcccaccccggagcccgggccgggccagatcctggtgcgcaaccagttcatgtcggtcgacccgtacatgcgcgggcggatgaacgacgtgaagtcgtacgttccgccgttccagatcggcgcggccctcgacggcggggctatcggcgaggtcgtcgcctcgaacgcggccgaggtgccggtcggggcgaccgtggtgcacggtctgggctggcgggactatgcggtgctggacgccgggcacgcgcgggtcgtcgacccgaacgccgcgccgacgctctccgcctacctcgggctgctcggcatgaccggtctgacggcttatgtcggcctgctcgacatcgcccagttccgcgagggtgacgtggtcttcgtgtccggcgcggccggtgcggtcggcagcgtcgtcggccagatcgccaagctgcgcggggccaagcgcgtgatcggcagcgccggctcggccgacaaggtccgccacctggtcgacgacctgggcttcgacgcggcgttcaactacaaggacgcgccggtacgggatcagctgcgggccgccgcgcccgacgggatcgacgtgtacttcgacaacgtgggcggtgaccacctggaggcggcgatcgggtcgctgaacaagttcggccgggtcgcgctgtgcggggcgatcgcgcagtacaacgacaccgcgccgccggcggccccgcgcaacctggcgctggccatcggcaaggagctgaccctgcgcggcttcatcgtcggcaaccacggcaaccggatgaaggacttcgtcgccgaggtcggcggctggctgcggtccgggcagatctccgcccaggagacggtcgtcgacggtctggccaacgcgcccgaagcgttcctcggtctgatgcgcggggagaacaccggcaaaatggtgatcaaaatctagggatcgttcagtttacctggtggtgagctgtccgaacgggcaaaagcctcggatcgaccggggcttttgccgctcaccgcgcagagttgatcattcggatacgaaccgtccggctaccggtactcatccgtacggacgacgtcactgacggaaagcagacactagcgttccggtgtggcaaatcggttccaactttggggacaagctggctgggccagcgccgaggtcgtcggcgagactcactacgcgaagtcgatacgcgcgctcttcgggcccgacttcaacccccaaggcaccgacatcaccgtcccggtccagctgatccccgaccgcagcaaccgccacgaccgcaacgccgtcggagtatggtccgacaacgccctgctcggccacctgccccggccggaagccgcccgttacgtcggcgtcctcaccgcgctcaccaagcggaagctggtgcccgaggtcaccgcgcagatccacggccgcgaatggggtgagtacgagggccgcccgcccgccttcgtcgccaccatccgcctcgacctgggcgagccgcacatgctggtgccggccaacgacccgcccgtgcacgagcaccggctgctgcccaccggttccgcgctgcaggtcaacggccaggagcagcatgtcgaggcgctcgccgcgttccagcgccccgagggcgagtgctgggcgtatgtgacgctgcacgagatggccgaccacctggtggaggtgcgactcggtgacgcccgggtgggcgacctgagccccaagacgagcttcgaactcgtcccggtcctgcggtaccaggccgaacgcggcctggtggtggcggcccgcgcggtggtgaagagcaacgcggtcaagaccgaggtgatgctgtacgtcgcccgggtgcaggacctgccggagacctgggtcggcccgtcggctcgcgccggcgcggtcagcggccgggtgaccccggtgtcgccggcggccaccccggtggtcccggccaccccgggcccggatccggtcggtcccggcggcgcgtcgacaccgggctgggtgaccggcagcgacgcggtgccgagccgtgcaaccggctccggcgatggcgccccggcctgggcaacgggttccggcgcctccgcgccggcctggtcgtcagcgtccggcggttccgcgccgtcctggtcgtcaggggccggtggttcgacaccggcttggacgtccggttctggtgacgctgccccggcctggacgtccggcacccatgaggccgcgccggcgtggacttccgggaccggtgacgccgcgccggcgtggacttccggaaccggtgacgccgcgccggcgtggacttccggaaccggtgacgccggacagacgtggacgcccgagtccggcgaagtggcggcgacgagagcgtcgggatccggcgacgccgtgccgacctgggcgtcgacacccagcgacgcccagccgacctggatggaccgcagcgagctcgtgccggcctgggtgcagccgagcggaacggtgcccagctgggcggcatcgatgagcggcccggtgccgaccatcgccggccggccgcaggcgaaggacccggtggtgcccggcgtggccgcgccgccgatcccgggagtcccgacgaccccggtccccggcgtgtcggtgtccggcggcccggcgtactcgacgtccccgggcgccggcagctcggctgactcggtgttcggatcctccagccgtccggtctccgggacgtcggctggttcggcgtccggattgcctggtcgtccggtctccggggtgtcggctggttcggcgtccgggttgtcccaccgtccggtctccggggtgtcggccggttccgcgagcgggttgtcccaccgcccggtctccggagcctcggccggttccgcgtccggtttgccgagccggtccgtttccggagtctcggggcagggcgccgggttgtcggccggccaggtctccagcctgaccggcggtttcccgaactcgccggccggccggccgaactcgtcgcccgaccgcgacggctcgcagcccgacttcctcaacgcaccgaccgggcttacccggtcgccgggcgccgggggccccgggacgccgccgtccggtggcaccggcccggtcagcccggccgggccgagcgccggcgcgcggccgaccggaatgttcggcggcgccggtgagatcgccgaaaccacggtcatcccggcgctgagtgccgtggtgctgagcaaacaccaggctgccggtacggctccggtctcctcggcccccgacctcaaccgccacgccccgattccgccggctccgaccggcatcaagttcgccgtgccgccgggctggccggtcccgccggacggctggtacccgccggagggctggcatccggacgcctcgtggccgcccgcgccggcgggctggcagtggtgggtcccgacctgggaatgatcgtcctgcgccgggcatgacctgtgctcggccgggccggtgacctgcgggtcgggcagatcgtggtcggtccgaccgggctgatcgtggtcgctgccaaccggtccccgatccgcctccaagtccgcccggctcgccgggctggtgccagtggtgctggtggtgctgatgttattgccagttggcccgatccgtgcggaacgtcggattaacccgaaaaaacgccaccatgcggcccgtcgccttgctggaatggaaaaatgcggtgggatcaatcggacgggttgaccgggcggcctgatgcccgtgtgcgggcgacgctggaacaatggcgggatgggctgctcgacctgaccggcgccaatccgctgatcgacgtgcggacgacggcgcccggggtggtcgagatcgtcagcccgtcgccgcgcagcgtcgtagaggcgctgcagcagggccgcgagtgcggtttcctgggcatcgaggagcaggcggaaggtccccggccccgggccgcccacgtcttccagaccacgatggccgacgccgagatggacgccaccctgcgggcgctgcgccgcgcagcccggcgcgacctgctcgaacagggcgttgccacgctctacctggggctcggcacggttcgctggcgcgacggcgccaacgagcacatcagcccgatcctgctgatcccggtggacctgatcaccccggatccggaggattacccgcggctgcgggtccgcgccgaggacccgatggtcaacccggctctggacatctgcctgcgccgacacagcatcgagttgcctgcggtggacagcctggcggcgctggacgtcacggtgttctgggcgcggctcgacgccgccctcggcgaccacccggactggcactccgacgagtcggtgctgctcgcccggttcgccgtgcaccgcgaggtgatgtacaccgacctgctcgaccacgagcggcagatcctgtcccacccggtggtccgggcgctggccaccgcacccgaggcgcaggccgacgcgttcaagttcgaggtgatctccggccgccggatcgacgaggtggccgccccggacgacgtgccgctggtgctggacgccgacgccgcacagcgggcgtgcatcatcgccgccctgcacggccgcagcttcgtgatgcgcggcgcgcccggcaccggcaagtcgcagaccatcgccaacatggtcgccggtctgctgcacgccggccggcgggtgctgctggtcgccgagaaggccgccgctctggacaccgtccgcgaacgcctggaacccgccggcctgcacgactatctgctcgaactgcacagcggccggaccggccgggaccacgtggccgctgccctggccgccgccctcgacttcatcccgctgccgccgccggatctgtccaccgacgaacgggaggcgttgcgcgagcaccggcagcggctcaacgcatacgccgaggcgatgaacgaggtccgcgaaccgctcggccaccgcctgcacgacgtgctcggcatgtgcgcgcagatgaccgatgtgccgcaggctccggccccggccgagctgccgatcccgctgaccacccagtccctgcagcgcgtccgggacgccgccgagcgtctcggccgcaactggcgaccggcccgggagggcgacgacttcctctggcacgacgtgatcgaccgcaaccggctcgacgcccggctgcatcaggcgcaggctgccctggaccacctgtgcgaggccatcgaacgagacccgctcgccgacgccttcctgatcagctcgatcggcgaggcgatcaccctgaccaccctggtcgggcacgccgcccgccggccggccgaggccgccgacgattggctcacgatggccagcctggagccggtggcccgggccgccgagggcctgctgcgccacctgaagacgctgcaccaggcggaggatgcggtccgcgccaaggccggagccacctggagcgcgttgcccgccccggccaagctgccgatcatcccgaccctgctgcacctgaacccgcccgcggtcgagttgctgccgctgaccgccgcacaggcgcgcgggctggcccgccgcttcgccgacgaggcggaccggctggaacagcaccagcacagcctggaccgggtgaccgcccggctcggtctgccgaacgtggtggccttcaccgacctgccccggctgaccgcgatcgtcgacctgctgtcccgcccggacaagccggaacctgcctggttcgacagtctcggcatgaacgccgcgcacgccgcgatgcggaatctgcgccgggtggtcaacgtggtcaaggccgccgagagccgggcccgcgagcacttcagtgacaacgccctggtcgagccggtggacgagctcgccgagcgattcgcccatcagcacaagggcctgcggaagctgagcgcgcagtcgcggcgggacaagaaggccgccgccgacatcgcccggccggacgtcaagcggtcgcaggcggtcgccaacctgaacgcggccgccgcctggaagcgtgcgctgcaggagctcgcggaggccgagcaggagtacgccggcatcctcggcaagcactggcagggccaggacaccgacttcgacgcgatcgagcgggcactgcggaccgccgcgcagacccttgaggtcaccccgccggaggcgctgcccaccctgatcgagcggatctgcgcgccgaccccgaacagcgcgatcatccggatcgtcggcgaggccggcaaggagttcgaacgctggaccgcggcgctgcgcccaccgcccgagcccgcgccccgcccacagctggccaccggcccgatccacgacgcggtgacctggctgcgcgcccacgtcgagccgttcaccgcggtagccgagctggtccaggcctacagcgcggccgccggccgggacttcaccctggccgaggcggcggcgatcggactgctccgggagagcgcgtcggaggccgccgcagccctgtcggccaacgccaaggagtacgccaaggtcctcggccccgcctaccgtggcacgcagaccgacgtggaggcgctcgccaccgcgatggcctggacctccgaggctcgccggatccgcaacggcgcggacatcgcgttcaccctcgagcaggccgaactgctcagccggacgcgtccctcggacaccctgccggcccgggtcgccgagtggcaggccgcccgcgactggatcctgcgcgccttcgcgcccagccggcacccggccctcagcgccgctctcgacgagcgggacacctcccgggaactgctgcgcgaactgctcgacgacacacgcggccagcaggagtggttcgactgtcagacggcccgcgcggtcctggccgagcacggtctggacccggtggtcgacttctgcatccgtgaggatctgccggtcgagcagctcctgccggtgctgggccgggcgctcttccagtcctgggccgacgcgatcatccggtccgacgaccggctggccccactcgacgcggtctcccgcgaccggctggtcgacgagttccggctctgggacgccgggctgcagcgcgccgccgcggccgaggtgatgaacgcggtcgacgcgctgcaaccggcggaggccgcggccggcgaggcggcgatgctgcgcgccgcggctgcccagcagggccgccgcctgccggttcgggacctgttcgcgcgtaccgcccgggcggcgatggcggtcaagccctgcctggtcatgtcgccggccgacgtgagccgtctgctcccgcccgacctgcacttcgacgtcgtgatcatcgacgaggcgtcccgggtgccggtgccggacgcgatcacctgcgcctaccgtggcaacgccctggtggtctgcggcgacgaccggcagctcaccgcgacaccgatccccggcggcgactcccgttcgatcctggagcaggcgctcagttgcgacgcgttccgcgtcctcgacctgaccacgcattaccgcagccgcgacgagtcgctgatcgcgttcgccaaccacgccttctatcaggggcgcctgcacacctttccggcgttcgcgccggccgggccggaccggggcgtgcagctctacccggccatcggcgacatgccgctcgccgacctggtcgcgacccgggtcgcccaccatttcgtcacgcggccggatctcagcctcggcgtggtggtgtgcaccgccgaggacggctacgagatcgaggccgcggtcgccgacatgatcgtgccgcccgaggacgaccggctgcgcggtttcttcatcaagggcctggacgccgtccagggcgatgagcgcgacgtggtgatcttcgcgatcaacggcgacctggacgggctctccggaccggacggctggcgccgcctcaacgtggcgaccacccgcgcccggcgccggctcgaagtggtgtccgcggtccgcgcccgggatctctcggagaacgacgtcagcctccgccacctggccgacttcctggagtacgccgcccgcggcatccacgcgctgggcctggaggactcgcacccgggggagtcgcagaccccgttcgaggactcggtccgggacgtcatccgcggctggggttaccgggtcagcacccgggtcggggccggcgcctaccggatcgacctggcggtccgccgctccgcccggcgcaacgccccctacgctctcggcatcgagtgcgacggcaccacgtacgactcggcgccgaccgcccgggaccgggaccggatccgcgagcaggtgctcgacagtctcggctggaagctgcaccggatctggggcaccgcctggtacctcgaccgggaccgcgaggagacccgtctgctggccgccatccaggacgcgttcgccgggctccccgacgaggaggcgccaccggaactgggcgtcgccaccgcgccggaccagccggaagacatcgcgcacgccgcgcccgcaccggcagacgccgtcgagtacccggtcgcggaggcggcggagggctacggcgccggctacgccgacaccgccggggagacgcccgctccgcggacgacccgattggcgtacgacgaagtcgtggccgccgtccccgcagcgcaagccgcgccatcgtccggcaccgtctatgcgactgccgcggcgccggtgtccacgttcacccaggcggcctccgacgagcaggttcggacattcaccgggtcggcattcaccgagtcggcatccgccgagccggtcgcacgggtgaccaccgagagctcgggcggcggataccccgacgcctccgctgactccggtctcgacctcgccgagcgggaaggtctcttcgcctggaccgacgccgacgacgccggggtggcccagacggaggccgccgccgaggcggacctcgccgacgcccacgacgccgacgaccgccgtgtcaccgaggccgctctgatcgccggcctcggcctccgcgggagcagggcttcgtcgaccggtatgcccaccaccggtgacgtggccgagttcgaggagtccgccggtccgcccgacgacggcgccctcgacgagcgggtcccgctgatgggcggcgacctgccggctcagtccgtcggggccacacccgacgagccggttgtcgccgagacctccgaggccggcatcgccgtctcggccggggaacggctggcccacgccgatcactccggtctggccggtgtcgcggccgagttcgcctttgcgcaggccggtgctgaggaactcgccgccgccgaggcctacctgggcgccaacctggaggccgcgatcgctcagctccgtgccggcgggagtgagtccgccgagtggccggtcgagccggacggcgctccggccgagccggccatgaccgcgacccatgccgacagtggtgctgcggcccgaaccgacaccgctgccaccagcgacgacaacggctcctggtccgctcctgcgatggacaacccggttcgggccgagtggcccttcgccagtcgggccgagtccccgtcccgctccgactggtccgctgcggcggagtcgcacccggagccccccgtacccgggagcgacccggcggtcggctcgcccctgcagccgcttgccgtcggctccgaagccgaccggtcgatcgccgaggctggcgtggactggtccgcggacgccgaggaagccgtcgtggaagtccaggaggagtccaccatccgggcggagtggccgttcgccagccgggccgaggcgcccgaacgcgtcgcatggcccgcggccggggaccggcccggggtccaggagatctcctggccgacggctgaccggaacactggtgatcaggaacctcgggtccaggatgtcgcgtggcctacggctgaacgtccggggggaacccgtgccggccgggagccagaggtcagggaggtcgcatggccgacgaccgggcagccgaccagccgggagccgcaggtcaggaacgtggagtggccggtcgccgagcgcgaggagcggacggccgccgaccgggagccgcgcgtgcagcgggtcgagtggcccactgcgacccgcgaggaaggggtccagtggtccgccgccaccgatgagccgatccagccggccggacggcgagtctcctccgtcgagtggcccaccgccggagccgaaccggccgagcggcgagtgtcgtccgtcgagtggcccgccgccacgcgggaggagccggctcagggcaccgcatggccgtcggataccagggcgcgggaggccggaaccgtgtcgtggccggtggtgagccgggacgaccagacttctgccagccgggaggatctcgccgaggtggccgcccgcttcggggtcggcaccgaggaattggccgcagccgccgcgcaattcctggccgggctgcacgagaccgcggaacccgccgaccgtctcgacgcgatctcgcagatccgggccgaactcaccgagtccgccaacctggaaccggaactggccgatgcggccgccgccgtggccgagcagtcgctgctcggcgtcagggccgagcgtcccgactggttcctggagatggtggggcagccggacctggccgccgcggtggccgagttcgaggagacgatggccgcaccgcccggctggacccatccgagcgtcgccaccaccggaccgcatctcgccggcgcgcaccagcccgaccccgtgctcggttcggagacgatgctgcaggaggagacccggcaggatgtcacggcccgggccgccgagacgaccggggcggcgggggcgcacaccggcgagtgggcacacccgtaccggaaagcggacctgcccccgctgccggccggcgccgtgctcaccgacccgagcctgcggccggaactgatcgccgccgtgcgaaggctggccgagatcgagggcccggtgcacatcaacgtcgccctgcaacgcatgcgcgagcagtgggacctggcccggatcagccggccggcccgcaccgcgatcgaggccgcgatcgaggaggccggagtcgcctgggacggcaccttcctcggcgaccccgaccaggacatcccggtggtccggcagcgggcggacggggtggcccgcaaggccgaccaggtctccgacgccgagctcgcgattgctctggagaatctggtgatcgacgggggcgtgctgccggtggacgagttgctggccgcggtgaccaaactttacggctggtcgtcgcgccgctcggcggaactcgacgcccggctcaccggcatgatggccgacctggtcgctgagggccacctgctccaacagccgaacggcctggccgccgcgcacggcctgcccgaccctctccagctctcccgtcatgaatccggtcaccgccacgcgcatcacaccacccgtcactgagattcggccccagcgcacggcccgacgccggctgccccgcatggtgggggtggccgggggcctcgtctcggccgccgtgtccggtgtgcggatcaggttggaccccggcgccaccggcggtcaaggaggggtaggtcacgcgaaaaatttaggctcgtgagctgcagaaatggctcattgtcggggcattgtgaacccctcccgcccctggcccctgtcacctcgctccggcacggcgtaccgtcgcggcaccggcaggcgaatgcggcgagagcgaggaccagatgcgggtgcaccacctcaactgcggcacgttgcggccgcccggcggtgacctggtctgtcacgttctcctcgccgagtccgatgccggtctggtgctgatcgacaccggcttcggcctggccgacatcgctgatccggcgacccggatcggcccgccacgacacctgctgcgccccgcgctgcgacgtgcggagaccgcggtggcccaggtcgagcggctcgggttccgaccgtccgacgtgcgtcacatcgtggtgacccacttcgacatcgaccacatcggtggcctcgccgacttcccgcacgcccgggtgcacgtcaccgccgcggaggccgagggagctctgcgtgctccgacccgcggggaacgccggcgattccgcagtgcccagtggtcacacggcctcgatctggtcgaacacaccgccgacggggagcggtggcgaggcttcgccgcggccaaggagctcaccgagatcggcccgggcgtcgtcctgatcccgatgcccggccacacccggggacatgcctgcgtcgcggtcgactccggcgaccgctggctcctgcactgtggcgacgccttctatcaccgcaacaccctgaccggcgccccggtgccgctcggtctccggctcgcggagatcggcgtcgccttcgaccgcacgctggttcgtgccaaccatgcccgtctcgccgccctccaccagcgcgccgagcccgatctgacccttctctcctcccatgacccggtcatcttcgccagcctcgccggccactgaccccccttccggcgatccgcggtcgccgcggtccgtgccgcggtccgtgcccggatctgtgccgcggtccgtgccccggtccgtgcccggatctgtgccgcggtccgtgccgcggtccgggtagcgggccgtgcccggatccgtgccgcggtccgtgccccggtccgggtagcggtccgtgctcgggtccgggtcgcgcggggagggccgcatgagctgcggaggatagtgactgtttgcgctcacagttgacttggactcgggcgggtgaggcgcgagttgacggcgggcgcgaagttgcggcttctgggtcttcgggctggccccgatgtggaagcggggacttcgggtttagcgcggacgcgtctgatccagtagagtgagcgctaacaatcggggttcggaagctgaggatggcggcgacgtgactatcgggtcggaggctctgcgccgggacgtgtggctggccaaccaggtgattccggaggctggtctggcccagctgacctggggaaacgttagcggtgtggatcgggagggtggttttttcctgatcaagccgtccggggtttcctacggtgatctgaccgcggacatgttggttccggtgaatcttgaaaccggcaaggtgctcgccggggatctgcggccgtcggtggacaccgagtcgcatcgtgcgttctacctggcgtggccctcgatcggggggatcacgcacacgcattcgacgaacgcggtggctttcgctcaggcgaatcgggatattcccgtgctcgggaccacgcacgcggacactttcaacgggccggtgccggtgacccgcgggcttaccgctgaggagtgcgcgcacgactacgagttcaacaccggccgggtgatcatcgagctgatcggtgacgacgaggcggcggccgcgatgccggccgctctggtcgccaaccatgggccgttcacctggggtgtcagcccgaagaaatcggtcgagcacgcgatcatcgtcgaggcggtcgccgacatggcgatccgcaccctggcgatcaacccgcaggcgttcacgccgcagcacttgcaggaacggcatttcaagcgtaagcacggcccgggcgcctactacggcaatcccggcgccgccaaggcctgacccgcgcgagcgcatccgtagccggtggttcgcggcagcgagcaaccggcgccgaacagtacgcgatgcgcacgcgggtgggccctgtcgggacgacgccccaccctggctcggatcaccgagcggggcggggtgacgttccgccggcccgggcgtagctgggagcatcgcccgggccggcaaaccttccccgcacatgtccacgccgttccggacgtgatcagtaggccggcgggtgggtgaggtcccggacgagggcactgactcgttgccgaaaaccgggaattgcggcgcgcctgttgccggaacgagggagcgggacccgggtgttgcgggtcgccggctcccggctcgttgtcggcgctgcgttgcctcggacgcccgcagacccggcgccggtttgtccgagagcagcggtggccgccgtggaatcgtcggtcgtgccggttcccgcgatgccagcggtgggctcgtggtcgctggcggtgggctggtgcctggtggcagtggcggtggtgggctcgtggttggcggcggtggtcgtggcgggctcgtggccggcggcggtgggtgtggtgggctgctcgtggccggcggcggtggcagtggtggattcgtggctggcggcggtgggcgtggcgggcttgcgcctggttgttgccggtccattggtggctgggccatcgtggctgcggagttcggcggtgcgctggtgggggatttccgcggggactggggcctggctcggggtgtgccaggtgaagtgggtgccggacagggtgacggtggcgccgggtgggcagaggccggtttcgcggtcgtcgggggctggggaacggccgtagctgatcatcaggctggtggtggtggtctccgggtcggtgtggactgcccagatctcgccgtatccgatgaggttgttgccggctggagtcaggacggcgccgcgaccgcggagggtgatggtggtgtcgtggccgtggttgtcacggatgtgcagggtgccggagagccgggggtgccggcgacgccaccaccctgggacggcgggttccgtggtcaatccgctcacctgtcctttcctcatcgaagcaggttgcgcccgaaatttcgggaaattttggctttagggtgatgcctggcatcggagcggggcgtgacatggctgtgccggcgagggaaggtccgccctgagcgcccgccgggcgaccacgggaagcgacctggcggcaggatgcgcggtgatagacggcgcaacgtggtgagacggcgccgcggtccacggcgggcgcgcggtcgtggcaggccgcaccgagcgggacagatatgccgtgctggggcggcgtgcggtcagtgacggccacgggggcggcggcgggccgcgcggcgtggggtgcaggcgcggcgtgcagtgaagacgcggcgtgcggtgcaggtgcggcgtgcagtggaggcgcggcgtgcagtggaggcgcggcgtgcagtggaggtgcggcgtgcagtgcaggcgcggttacggatcggtgtgcggtcggtgacggccacggggcggtagcggagtgtgcggcgcgggacgggcgcgtggtcagggcgcccacaggcctggcgggcggaggcgcggccggagaagggcggcgcacggtggtggcccgccgggtgggggcgggcccgggagatgaccgtgtgtcgccgtcgaacacccctcggactgtaaccggcgggggcggtcaggtcgcggttcattcaccgccaagggtgaggggacgccgcgggccggtgctggagcgcagcacgagttccggttggaccaccacgttggacagggggccgtccgtctcctcctgcgccatgtggtccaggagcagagccagcgcgcggcgccccatttctccgaaatcttggtgaatagtggtcagtggcggtaaaaagtagccggagtcgggcatgtcgtcgaagccgaccaccgacacgtcctcgggcacccgtcgcccagcctcgtgcagcgcccgcagcacacccagcgcgatccggtcgttggcgcagaataccgccgtcaccgccgggtccgcggccagccgccggccctgctcgtacccggcggccgcgtcccaccagccgggggtgatggggggcaccgccgccccggccgccgacagggtctcccgccagccgtcgacccgggcctgcgcctccggccagtcgggtggcccggccgcgtggtgcaccgtggcgtgcccgaggtcgagcaggtgccgggtggcgagccgcgcgccggccgcgttgtcgacgcggacggtggggaacgggtcggcaccggtgccggcgccgccgacggccacgcaggcgagtccactgggggcgtgggtgagggccgtggtcaccgccggcttcggggcgatcgcgatgatcccgtcgacgtcgtgctgggcgagccggtcgaccgcttccaggaccggccggtgcgccagctcgcggaccgtggcgacgctgaccaggtagccggcggcccgggccgcgctctcgatgccgtacagcatcgattcggggccgaacagggtggtctcgaagccgatgatgcccagcgtgcgggattcccgggtggccagggtgcgggccgccaggttgcgccggtagttgagcgagcgcatcgcggcgagcacgcgttcccgggtctccgcccgcacgttgggatgatcgttgatcacccgggacacggtctggtgggagacgccggccagtttcgcgacgtcgcgcatgacgctcccgcgctccttgccggagcgcggccgggtcgcggtgaagggcatctgggcagccggtccgaggtccggcgccgggtctgtggtcggcattggacgatatctaccaggtgaccgtctgctggccctgggtgagatcgccgttttggcaacctcttggaaacaacgaatctgctctcttgacgcgcacgatgagaacggtaacactcacgaaacgaaagctgtgacggcgctcgcagctactcgatgaactcctggtactgacacgtatatgccagtgctggctcctttgttaacggtaacagtttgatggaggttaaggtgcgcgtgaagttgatggcggcggcgctgacgggcatgctggccgtgtccgcgctcgccggttgcggcagcaagagcgacgacgccggttccggttcggcgaactccggcgggagcggcaagaagctggtcctcggcttctcccaggtcggtgcggagagtggctggcgcaccgcgaacaccaagtcgatccaggaggcggcggccgccgcgggcttcgagctcaaattctcggacgcccagggcaagcaggagaaccagatctccgcgatccgcagcttcatcacccagcacgtggacgtcatcgcgttctcgccggtggtcacctccggctgggactcggtgctcaaggacgccaaggacgccggcatcccggtgatcctgaccgaccgtgcggtcgactcgcaggacctctccctctacaagagcttcctcggctcggacttcgtcaaggagggcaaggaggccggcgactggctggtcaagcagtacgagggcaagtcggacccggtgaacgtggtcgagctgtccggcaccaccggttcggccccggcgatcgaccggcagaagggcttcgcccaggcgatcacggccaacccgaacatcaagatcgtcaagtcgcagaccggtaacttcacccgggccgagggcaagacgacgatgcaggcgatcctccagtccaccccgaagatcgacgtgctgtacgcccacaacgacgacatgggcctgggcgccatcgaggcgatcgaggcggccggcaagaagcccggcaaggacatcaagatcatcacggtggacgcggtccacgacggtatgcaggccctgtccgacggcaagatcaactacatcgtggagtgcagcccgctcctcggcccgcagctgatggacctggccaagaaggtcaaggacaagcaggacgtcccgcagcgtgtcctcaccgaggagaccaccttcacccaggagcaggccaaggccgcgcttccgacccgcaagtactgagccggtagtcgaagcaggtgcggaccaccccggcagcccggggtggtccgcaccgcgcgaacggagcgcatgatgggcgaaccagccaccaacccggtcctcgagatgaccggcatccgcaaggtcttccccggcgtcgtcgccctggacggcgtcgacttccgtttgtaccccggcgaggtgcacgccctgatgggtgagaacggcgccggcaaatccaccctgatcaaggtgctcaccggcgtctacgagatcgacggcggcgagatccggctcggtggcgacgtggtccggatcgccggcccgctggccgctcagaaggccgggatcagcaccgtgtaccaggaggtcaacctctgcaccaacctcacggtcgcggagaacatcttcatcggccgtgagccccgcacgttcggcaagatccgctgggggcagatgcgccgccgggccaccgagttgctccagcgcctcgacctggacatcgacgtgtccgccccgctgagccagtactcgctggccatccaacagatggtggcgatcgcccgcgccgtcgacatctcggcccgcgtcctgatcctcgacgagcccacctccagcctggacacctccgaggtggagcagctgttccgggtgatgcgccggctcaaggcggacggggtggcgatcctgttcgtctcgcacttcctcgaccagatctacgagatctccgatcggctcaccgtgctgcgcaacggccagctcatcggcgagtaccggaccgccgagctgacccaggtgcagctggtcgagaagatgatcggcaaggagctcgccactctggaagatcttgaggacaaggcacagagcgcccgtacgaaggcggccgccgccgagccgatcctcgaggcccggggcctgggccggaccggtgcgatcgccccgttcgacctgaccatccaccagggcgaggtggtcggcctggccggcctgctcggctcgggccgcaccgagctggcccggctgctgttcggcgccgacaaggcggaccagggcacactcagcgtggacggcaagccggtgtcgctgcgcgacccgcaggtggcgatgaagcgggggatcgccttctcctcggagaaccgccggaccgagggcatcatcggtgacctcagcgtccgggagaacatcatcctggccctgcaggcctcgcgcggctggacccggccgatcccgcgccgcaagcaggacgagatcgtcgacaagtacatcaaggcgctgcagatccggccggccgacccggagcgcccggtgcgcaacctgtccggcggcaaccagcagaaggtgctgctggcccgctggctgatcaccgagccgcggctgctcatcatcgacgagccgacccggggcatcgacgtcggcgccaaggcggagatccagaagctggtcgccgagctctccggcgggggcatggcggtgctgttcgtcagcgccgagctggaggaggtgctccggctcagccacaagatcgccgtgctgcgcgaccgccgcctggtcgaggagctggacaacaccgccggggtcgacgccgaccgcatcatgcagaccatcgccagcggagcaacctcatgaccatcctgaagaaccggctgttctggccgaccgccattctcgtggcgatgctgatcgtgaacgtgttcacgtcgcaccagttcctcaccatccacgacgggcacctgttcgggacgctgatcgacatcatccggggcagcgccccgctgatgctcgtcgcgctcggcatgacgctggtcatctccaccggcggcatcgacctgtcggtcggttcggtgatggcgatctccggcgcggtcgcctgtctgctgatcaaggacctgagcgaccagaacgcgctcggcgcggtgctgctcatcgtggccgtctcgatcggcgtctcggccgtgctcggcctctggaacggcgcgctggtcgcggtcgtcgggatccagccgatcatcgccacgctgatcctcatggtggccggtcgcggcctggcccagctgatcaccgacgggcagatcatcaacgtgcagtccagcccgtacgcgagcatcgccaccggtttcttcctcaccctgccggtggccttcctgatcgcgatggcggcggtcgcgctgaccgcggtgctgacccggcgcacggccctgggcctgctgctcgagtcggtcgggggcagcccggcggccagccggctggccggcatccgggcccgccggatcaccatcatggtgtacgtggtgtccggcgccctggccggcctggccggcctgatcgtgtccgcggacatcaagagcgcggacagcatccacgccggcaacctgatcgagctggacgccatcctggccgtggtgatcgggggcacggcgctgatcggcggccggttctcgatcgtcggcacggtgatcggtgccctgctgatccagacgctgaccgtcacggtggtcggcatcggtgtgccggacaaggccacgctgctgttcaaggcggtcgtggtggtcgccctctgcctgtcccagtcgccggtcttccgcgagaaggtgttcggaagattcaagtcgcgtcccgccgtgcgagccgaggtccccgcatgaaaaccacgatcgacgcgacgccggaggtcgcgcagaacgctccggtcaacccgaggcgccgcgtctaccggccgaacgccaagtacatcccgatcctcgccaccctggtcctgctgctcgccatgtacatcggcggcctggtgaacctggagcacttcgacgacccccgggtcgtggtcaacctgttccgcgacaacgcggtgctgctggtggtcgcggtcgggatgaccttcgtgatgctcaccggcggcatcgacctgtcggtcggcgcggtcatctcgctgaccaccacgctgaccgccaccctgctcaagggcgggtggccgccgttgctggtgctgccgctggtgctggtgctgggcgcgctgctcggcgccgggatgggcgcggccatccactacttcaaggtggagccgttcatcgccacgctggccggactgttcttcgcccgggggctggcgctctacatcaaccaggagtccatcccgatccgggacaaactctgggtgaccctttccgacctgcggatcccgctcttcgatgacgtcaagaccacgctgatcgcggtggtggcgctggcggtcgtgctgatcgcggccggcgtgctggcctggacccggttcggccgcaacgtctacgcgatcggcggcagcgccgactcggcgctgctgatgggcctgccggtggcccgcacccgggtgctggtctacacgatcagcgggttctgcgccgcgctcggcggcgtgttgtacacgatcaactccacctcggggcacgcgctgcagggcgccggcaccgagctggacgcgatcgccgcctgcgtgatcggtggagtgctgctcaccggcggctccggttacgtcctgggcaccctgctcggcgtgatggtcttcggcctgatctcgaccatcatcaacttccagggtgacctgaactcggcgtggacccggatcgtcgtcggcgtcctgctcttcggcttcattgttctgcagcgactggtgacacggagggctcgatgagcaacggggaaatctggttcctgaccggcagccaggggctgtacggcccggagacgctggagcaggtggcgagccagtcccgggagatcgccgcgcagctggacgcgcagctcgacgcggacgtggtctggcagccggtgctgaccagtgccgagcagatcctggacgtctgccggcgggcctcgtcgacgccgggcgtgctcggcgtgatcacctggatgcacacgttctccccggccaagatgtggatcgccggcctggacgcgctgcgcgccccgctgctgcacctgcacacccagcacaacgtggcgctgccctggtccgagatcgacatggacttcatgaacctcaaccaggccgcacacggcgaccgggagttcgggttcatcgaggcccggctcggggtgccgcgcaagacggtggccgggcacgtcagcaacccggccgtgacggcccggatcgccacctgggtgcgggccgcgcgcggctactcggcgatgcggtcgctgaagctggcccggttcggcgacaacatgcgcgacgtggcggtgaccgagggggacaaggtcgaggcgcagctgcgcttcggcgtctcggtcaacacctacggcgtcaacgacctggtcgcggtcgtcgaccaggtgaccgacgcggagatcgacaagctggtcgacgagtacgccgacgtctacgaaatcgccgccgagttgaagaacgagcgggcggagtcgctgcgctacggggcccggatcgaggccggtctccggcagttcctcaccgagggcggtttccaggccttcaccaccaacttcgaggacctcggcggtctgcggcagctgcccggcctggccgtgcagcggctgatggccgacggctacggcttcggcggcgagggcgactggaagacctcggtgctggtgcacacgctcaaggcgatggtcccgggtggcgccacctccttcatggaggactacacctacgacctgaccccgggcaacgaggtcatcctcggcgcgcacatgctggaggtgtgcccgtcgatcgcggccggcaagccgaagctggagatccacccgctcgggatcggcggccgcgaggaccccgtacgcctggtcttcgacgccgccccgggtaaagcgatcgtgctcggtctcgcggacctgggggagcggttccgcctggtcgccaacgagatcgaggtggtcgcgccgaccgagccgctgccgaagctgccggtcgcccgggcggtctggaagccggcgccgtcgctgtccacctcggccgagtgctggctgaccgccggcggtccgcaccacaccgtgctgtccgcctcggtcggcgccgaggaactggccgacctggccgacatggtcggcaccgaactgctgctgatcgacgaggacacgacgacccggcagttcaccaaccaggtgcgctggaaccaggcgtaccaccgtctggcccgcggtttcggccgctgatcacaccggtgagagggcggacggggcaggccggtcaccggcctgccccgttcggtgaatcggctgctgcgggcgggcggcgtacgacgcaagcgaaacgacccggaccgacagcggtccgggtcgtttcctgctgcctggcgccgggtcagcggtcctcgtcggcctcggcgtcggcctccggctggtgcgcgtggtgcccgcgacgcggggcggcctcgatctcctcggcgatcggctcctcctcgatcacctcggcggtgacctgcggggcgtccgcccagagcgcgcgcagctggccctgcatgaactgggtgaggcggccgcggtactcccggtcaaagttctccagggcctcgatctgctgctgcagcgcctcgcgcttggcgcccaggctgccgaccacgtcgtcgtagcgctgctgggcctgcagcttcaactgctcggcgccgtgcagggcgtccgcgccgatctgctcggcgcgctgccgggcatccgtgacgatcttgtcggcggcgcggcgggcctcctcggcgcgcgcctgggcctcccgcgccatggtctcggcggcggcgcgggcctcggcgagcacccgatcggcctcctgccgcacggtgccggcgtgcgactgcgcgtcccgggcgatctgctctgccgccgccagggcgtccgtgcggatcttgtccgcgtggtgctgcgcgctcgccacgtgctcctcggcggtgcgctgcgccagggcgaggacctgcagcgcctggttcggcaggcccgggttgggcgcgatcaccttgtgctccgaggtctcaccgtcagtcccgttgagaagcacttcgccacgatccttatctgagtcagtggttcggctccgggggagggggtccggagcgccatggccgaggagggggttcaaccatgatcggcggggatgctaccaagctgaacgggcagttagcgagggtccgagaggacactgcggatggtgaattgcgaggatgtcggcatttgcggctttgctcccgtttaggctccgataaagccgttccgacgcccctctaggacaccgatgcgacgcctcgccacgctgctcaccgcgacaaccctgctagccggaacgcctacggcggcacacgccgcggctccggtcaccctcgcctactggccgatgaacgagccggccggcgccacccggatgtccgacagcagtggaaacggactggacggacagatcggcgacgaggtcggcgtcgacaccgccgtgaacggggccaccggctaccggttcgaccgcctcgaacccgacaccccgccaccccacccgggccacctggtcgtggtgtccagcggcggcctcctcaatcccggcgtgcgggatttcgccgtcaccatgcggctgcggaccgtcaaccacttcggcaacatcatccagaaaggccagtccaccaccaccggcggcaacttcaaactgcagatccccaacggccacgtgcaatgctcgttccgcggcgaccgcggcgtcctcgaggccgacgcccccgacgccatcaacgacggcgcctggcacgtgatcacctgcgtccgggtgagcagcggcgtcgccctcgccatcgacggccggcgggtggccgggcggcaaggctggaccggcgccatcagcaacaactggccactgaccatcggcgggaaactcgactgcgaccagcgggcggtgggctgcgactacttcgccggcgacctcgactacgtcaccatcgagaccgactgacgccggcggtccggcctcggcggcagcggtgcgggcgccggccacccggccctgcggagatcatgggtcggcggtcggtggatgtccgcctcggatgaccgtgtagccgccgtccgggtgtggccgaagctgatcagcctcgacgacgagttcgctgccgtcatccagggccgtcgttgccgaagccggtcaggtcggccacgaaccgggggtgccgatcgacccgccagcccccggcgtcgaagcccaggtcgtcgaccacgaagcgggggagcggaaggtgccgtcgccgttgccccggggcggtccacaccccgtcgtcgccgaaggccaccacgtcggcaccacctcgtacaccgtgatggtctgtccttgaccgctgccgaccgcatgaccgtccggccggccgggcagcgacatgtcggcaggtagacccggatcggtgcgatcgacggtccactgaggattgcccttacctcgcccttgcattgcgtgaacgctccggttaccgagagtcggtctactccggtcggtgcgccggccggcgcgtccgctcacgaccgaaggagaacacgtgcgcaaccgtctgcttccgctggccctgacggccctgaccctggtcgccgccggcccaccggccccggccggagccgcccggagccccgccgaaccggtcgccggcacctggatcggcttcggctacaaccaggacccgcagtacgccggtggcaccggcacaccgactccctgggacccgcgggcgttccagcggatgacggagcggaccaccttcatccggccgccgatcgtgcgggtgatgctcaaccgcgactggttcaaccccaccggtgtggccggccggtacgagtgggcgagtgtgcagatgacgaatctgtaccaggtcctcacgcactaccggtccctcggcacccgggtccagctcgggctgtggggagtgcaaccgtcgagcgccgtgaacccgtacaccgcgaccgagaccgccacggtgcaggcggacctgatgcgccggctgtacgtgaccgacgcgtacaccaacatcgtccgctacaccggcgtcaacgagccgaacgtcaagaacgaggccaagaactattcgtacgccgactgggtcaccgcgaccaccaatctgcgcgccgccttcgccgccgagaaccttccggtgaccctgctcggcgggcccgacaccgccgaggccaccatctccggccaggacggtgacctggggctggagtcggtgaccggcggcgcggccgccaccggacagaacgcggtgtggcgggcggacgggctggccggtttcgacgccacgttctacgtcagcccggacaccggcgcggccgactggaagttctacacctcccgcgacggatcgtcctgggcgcagctcgacccggcgagcctggtgcagtccgcgccggtcaagacggtcgccaccaacccgtggtaccgctacgaggtgcgcaacggcgccccgctggcggccggcaccgactatctgcggatcacgctgcccgcgcacgccggcaccgagcgggcgctggcttcgctcaccatgaccaccggcgccggcggcaccgtcgcggatccgatgaacgactggagccacgcgacgtcgcacagttccggctggacccacctgcagggggcgcccaccgacgactggtggctggaggctgccggctcgtcactggtgtccgggctgcagacccacttctacgcccacgagctggacctcgccgacgcgggctatccggtgcagcagctgcaggagtatccggaggcgacgctgcgcgaggcggtccggcaggtgcgggcggccgcgcccggcgtgccggtgatcctcggcgagaccgggatgaaggcgccgaagtccaccgacggcaaggactacgcgttcaccgacgagccggagcacggcgtccggatggcggacctcgccgtgcaggaggtccgcgccggtgtcgacggcgcgatggcatggtgcctggacggctacgccgcggccgtgcagtgcgggatgtgggaccacgaggggaccaccgaggccaccaccgcgctgcggccctggttctatacctggagcctgctctgccggtatctgccggccggatccaccctctacgcccctgcccagcagcccggcctgcgcctgctgcaggcccaggcgcccggctccggaggctggacgttcgtgctggtgaaccgcggcacgacagcggtcaccgtgccgatgaccgcgccgaccggcaaggtgaccttccaccgctacctgtaccaggcagccgcgaatccgccgggtccggtcgacgccgacgggttcccggtgccggccggcaccttcctcggctcgttcgacggtggccgtccggtcacggtgcccgccgatgcggtcgtcctcatcacctcgatgtcctgagccggcacccggcgctccggcccggccggagcgccctcaccaccgtcatttccgtccggcggcgtggacaagccgtccgtcgatgaaggtcatggcgaccgaggccgcgccgatctcctccggtcgacccgcgaacgggtcgcggtcgaggaccaccagatcggcccgggcgccggcccggatgaccccggtgtcgtcgagacggttcacgaaggcggccccggcggtgtaggcggtcagcgcggtcgcgaggtcgagccgctggtccggcaggaacggtggatggcccgccccgtgatgcacccggttgaccgccacgtggatgccctgcagcgggtccggcgtgctcaccggccagtcgctgccgcaggccaggtggacccctgctcgctgcaggtcgccgaacggatactgccgggcggccagcgccgggtcgaggaacgggatggtcaggtcgtccatctgcggctcgtgcgacgcccagaacggctgcaggttggccgcggcgcccagcgcccggaaacgcgggatgtcgtccgggtgcaccacctgcaggtgggcgagatgcgggcgggtgtcgcggaaaccgttcgccgtgcgggccgcctcgacggcgtcgagggcctcgcggacggcgcggtcgccgagggcgtggaagtggacctggaagccgtgcgcgtcgagctcggtgacatgggatcgcagggcggccgggtcgatgaaggacaggccggtgttcgcggtggtgcggccgcaggagtcgcggtaggggctggtcatcgcggcggtgaagttctccgcgacgccgtcgagcatcagtttcacgctgtcgcagcgcagccggccgacggtgtgccggtcgcggttggcgagcagttcggggatctgctcggcgccgcggtcgcggtcccaccacagggcgccgacgacggtggcggtgagctgcccggtggtggcggcggcgagataggcgtcggagacgtccgggtagccgttggtggcgcagagcatcgcgtcctgccaggcggtgatgccgagcgagtgcagcagggtctgggcgcgcagcagaccggccagccgctcggccggggtgaccgcgggcagcagccgggcgaccagctgcatggcgccctcctgcaggccgccggcgggggcgccgccggggcgccggtcgatgcgcccgtcggccggatcgggggtggcggcgtcgatgccggcgagcgccagggcgcggctgttgacccaggcgccgtggtggtcgcggttgatcaggtagaccggccggtcgggcacgacccgatcgagcggctcgcggtcggggacgccgccggggaagacctccatggcccagccgccgccggtgatccagggcagctccgggtgggcgtcggcatgatcccggatgcgccgcaggcaggcgtcgaggtcgggggcgccggtcaggtcgcactggccgagctcgacgccgcccatcacggcgtgcacgtgcgcgtcctggaagccgggcagcaggagccgcccggccaggtcgaccgtcgtggtggcgggcccggtcagctcgcgcacgtcgtcggcgccgaccgccaccacccgcccggcgcggaccgcgaccgtggtggccggaccgcgcgccgggtcggcggtgaagacgcgaccgttggtgaggaccagatccgcggacatggccccactccatcacaccgccggtgtcagcagggtgtcggccggccgggcccgcgcgaccgggcgcacgctgaccagcgcgacgagcagcaccaggcaggccgccgacccggtgacctgccgggtcgccagcgccgcgaacgccgccgcataccccagcagcagggccagcgcctgtctgcgcggctgttcgaccaggatgaaggccagcaccgtggccaccgcgatcggcccccagtagtagcgcagcgtcaccggatcgctgaacacccggaccagcagtgcggtcgccggcgccaccgcgtaggcgagccgctgcccgcggcaccaccaggccaccgcggcgcagccgccggccaccagcaccgcctggatcaggcgcatctcccaggtcacgtccggcatcccgggcaggaggatcttgaccagggtgtcgttgtcgacgtgccagacgtggcggaacatcgcgaagtgtccggccagcacgaacggcaggtaggtggcgatgcccgcgaggccgcccagcacccaggtccgcagcgcgcgcaccggcccgctgaccgccagcaggcagggaaagcccagcaccgcccagggggcgatggcgaccgcgagacccaggagcgcggccgcggtcacggtccgttgtcgcttctgacagaggcttgcgtacgcccacagccccgggacggcaagctcagcgggatgtccgtaccacgggaccggcaccagcatccagagcagcacgagcaatccggtcgcggtctcccgcacggcgcgccgccgcccccggtccggggtgagccgcccgcacagcgtcatcgccgcgagtaccagccccacgttgaccgcgatcaccacggctcgggccggcatcccgtgcgttccgccgatcatcagcgcccggctgatcagcagttgcagcggcccggcctggttccagccggagtcgtagacaccgtccagccgcccgtcgagcagccgctgcccgtatccggcgaagtcgccgagatccagcggcatgtcccagaccagcagcgcgaggagggcggcgaggacggcggcgccgtagcggcgggcgcgcaggatcgtctccacccagcggggtagctccacggtttcctgatcggcgggccgggtaccgcggtgggtgcggatcaggtgccgatcgggagcaaccggatgtggggaccaccacggtccatcaccgaccacgatggtccggaaaggtctaggctggtcctatgccccgccccaccaagcagcagatcgacgacgagatcctcgacgccgcggccggtctgttcgcccggcacggtttccgggagacgtcggtgcagcgcatcgccgacgcggtgggctactccaagaccggcctgctgcaccgcttcccgaccaaggaggcgctgcaggcggccgtcatcgagcgctgcgtggggcagctccgggaggtcgcggcgggcgccgccccgctgccgaccggtccggagcgcgaccggatggtgatcaccggggtggcccagctcgcgcgggatcagcccggcgccgtggcgctgctgctgtcctgcctgctcgccgagccggagagcgagttcggcgtggccctgcagacgatcggcgagcaggtcgccgcggcgttcggcgacgagccgttcaccggtgccgcgctgggcggggcgggcgcgctcgccgacccggtccgctcggtccgggtgatcggcgcgctcggcgcgctcgcggtggccagcgtcgccctgcgcgactgtctcaccccggacgcggtcaccacgctcgtcgacgtcgcctacggcgcgctcgggcacccctccaccctctgacccaagacaagggaaacccatggcaacgctgctgcaccgcctcggcctcggcgccgcacggcatcgcatcgtggtcaccgtcgcctggttgctcgccctggtggccgtggccttcggcgcggtcaggctgtccggcgagaccgtcaacacgttccgcatccccgggcaggagtcgaccaccgcgctcgacctgatgaagcagcggttcggcgacgcctcggcgggcgccaccgtgcaggtggtgttcgagaccccggccgggcagaagatcaccgacccggtgatcgtcaaccaggtcacccagtcggtcacggcgttcggcaagctgcccggcgtggtcgccgtgagcaacccgttcgaccagcagaacccgtcggtctcgcgggatctgagcacggcgctgaccaccgtcacgtacggcgtgcagccgtccgaggtgaccgacgacgagcggtcggcgatcacggcggccctggcccaggccaaaaccggcggcctgattgtcgaggcgcgcggcgaggcgctgagcaacgcggccgacatcggcggcgcgtccgagggcatcggcgtgatcgtcgcgctgatcgtgctggcactcagctacggctcgctggtggcggccgggatgaacctgctgaccgcgatcgtcggggtgggcatcggcgtcgccggcatcaccacgttgtccggtttcgtccagctgcagtcgaccaccccgatcctggcggtgatgctcggcctggcggtcggcatcgactacgcgctgttcatcgtcacccggttccgccacgagctccgcgccggccgggacgtcgagtcggccgcggcgtacgcggtgggcaccgccggttcggccgtggtgaccgccggcctgaccgtggtgatcgcgctggccggcctgtccgtggtcggcatcccgttcctcaccgagatgggcctggccgcctcggccaccatcgtggtcgccgtgctggtggcgatcaccctggtcccggcgatcctggggttcatcggcaagcgggcgctgccgcgcaggctgcgcgacctgccgccgacgaccgaccacctggcggagggccgcggcttcatccggggctgggcgaacaccgtcacccgcaagcgggtgacgagcctgctgctggccgtgctcgcgctcgccgtggtggcgttgccgttcttcaaaatgcagaccaccctcgctcagcggtcgccggagggcagcacccaggccaaagcggacgccatcatcgaccagcggttcggcccgggcgtcagcggtccgctgctgatcctgatcgacggcccgcaggcggtgccgtacgcggcgaccgtgcagaagcagatcagcaccctgccggacgtggccctggccaccccgccgcggcctgacccgaagcagtcggcggcactgatcacggtgatcccgggctcgggcgccgaggatcagaagacggtcgacctggtgcaccggatccgggacgaggtggccgacagtgccggcgccaaggtgtacgtgaccggccagaccgcgatcagcatcgacgtgtcgcagaagctcaacgccgccctcccggtctacctggcgctcgtcgtcggcctggcgttcgtcctgctggtgctggtcttccggtcgctgctggtgccggtcgtcggggtgctcggcttcctgctcacgatcggttcggcgttcggcgccacggtcgcggtgttccagtggggctggctgtccggtctggtcaacgccggctccaccggcccgatcatcagcctcgcgccgatcatcatcgtcggcatcctgttcggcctggcgatggactaccaggtgttcctggtgtcgcggatgcacgaggcgcacgcccacggcgcgtcgccgcgggacgcgatcgtcaccgggttccggcaggccgcaccggtcgtgctggccgccgcgacgatcatgttcgcggtcttcgcggcgttcgtcccgcagggcaacgacacggtcaagccgatcgcgttcgccctggcggtgggcatcgcgttcgacgcgttcatcatccggatgatcgcggtgccggccgcgctggcgctgctcggccggtccgcctggtggctgccgcgctggctgcgctggctcccggaactggacgtggagggcgcggcgctggagcgccgcgagcaggtccccgtctgatccccccgggcggcgtcgcgatcagcggcgccgcccgttcgtcacgctgctatgccgttgttgacggtacttcggaaaacacagtagtgtgcggtgcgtggatacgacccagctcctcaagggcgtgctggatctcgcggtgctcgccgtgctgcgcgacgaggacggctacggctacgacatcctgcgccggctgcgcgccgccggcctgcaggacgtcggtgacgcgtcggtctacggcacgctgcgccggctgttcgccaacggcttcctgaacgcgtacgtggtgcccagcgacgagggcccgcaccgcaagtactacgcgctgaacgcggccggccgcgccgagctggaacgcaacggcaagacctggcacggcttcgccgtcatcatggacgacctgcttcgcgaccgggggaccgcgtgaacgacaccgcaaccgaccagatcgccacctacgtcgccgcggtgcgcctcgcgctgggcggggtgcccgagaccacccgcgaggagctgctcgacgacctcccggaacacctcgccgaggtgctcgccgaggacaacggcactctggtcgagcgtctgggcgcccccgcggcgtacgccgcggaactgctcgccacggccggattcgtctccctgccaccgcagcccgacccgcgctgggacaacctgcgcgagacccgcgacctggtgctgcgcgggctgcgcgtggccgacgtgcgggtcggcccggcgctgggccacgagcgggccagcgagttcctcctcctgctccgcccggcctggtgggtgctgcgcggctacctggtcgcgatggtcctcgccgtcgtgctcgaccacggctccggcccgatcggcctgctgccccggatcggcggcagcgacgtggtggcgctggccctgctcgccggctgcgtggtcgcctcgatctggttcggccgtcgcccgctgcccgacaagccctgggcgcggtacgcgctgtggtccggcaccacgctcctggtgctgatggcgctggccggcttcaccggtttcgacagcgacctgcgccagacgccgttcgtcgagtccggttacagcggcggtggcccggcggacgccatccaggacatcttcgtgtacgactcgcagggccacccgatccaggacgcccagctgtacgacagctccggcgccccgatccagctgggcaacgccacctgtaccgaccctcggaccgggaactcctacaccagctggcaccgcggctatccacactgcccggacgccgacccgttccagtccccgagccccgaccccaccctcgacggcgacaacccgcacgaggaggtcacgccctcggcgaccccaccctccgcgggcccgtcggcgagcggcaccccgtcggccgcgccgtcggcgtcaccgagtcgctgaggaaaggggtcggcccggcgccggggaaagcgccgggccgaccttttccggggatgggtcaggcggtccacttcaccgaggagttccaccggccggtggcgtcgaaagcggccatgttgtcccagccgtcgccggtgccgttgatgttcgccgggtcccagccgtttccggcgatcgcataccaggtcggttcccagtagaagacgccgatcgctccggcgttgcgggccgtgttctggatccaggtgaattcggtgccctgcccggtcttcgaggcggcctgcccgtcgcaggtcgtcgttccgggcaccgagttcgtctcgctgtcggcgttggccgtggtgtacatgtacgccgtctcgacgatcaccacgggcttgccgtaccgcgatttcacgtcggcgatcacgttgtacagattggccagcgtgccgtgccacatgcagtagtaggaaagcccggtgacgtcccaggacacgccctgcgccttgatgccgtcgtagaaccagcgcgcgttcgcgtcgctgtccgcgtcggccgtgtgaatcatcacctgggtgccgctgttgcacgccttggtcgcgttgtagccctgtttcagcaggccggccaccggcgcgaaattgttgttcgacacctttccggcaggccacagcatgccgacgttgatctcgttgccgatctgcacgctgtccggcgtggtgccctgcgacttcagcgcggtgcacacgtcgtaggtgtagtcgtacacgtcggtctgcaaccggctgagcgagtgcgagctccacgccaccggcggatactgcttgccgggatcggcccaggtgtccgagtagtggaagtcgaccagcagtttcaggcccttggccttgatggctttcgcctgctgcagcactttggccttgttgttgtatccgccggccgggttgttccacacgcgcagccgcaggtaattggcgccggcgcctttcaggatgtcgtacgggtcggcctgcgcaccggccgcggtgtagtacctgccgcccaggtcgagggtccgctgcagcgacgagacgtccgcgccgagcatggtgagcgaggcggcgtgtgcgggggtgggggagagcgccagcatcagcagcaccgctccgatggcggcgccgatggatctgcgcatgtcaactccttcgggggtaggagagaaggggtacttcagaagcggatgtaggggttgatccgcccgtggaagtcgaaggtcgccatgttctcccaggcgtctccggaatgctggatgtcctcggggtcccagccgttgccgtcgaccgcggtccaggtcggctcccagtagaagacgcccagcccgccggccttgcgcaccacgtcctgcacccggcgcagttgctccgcctgtccccgcggcgacgcgggaatcccgtcgcacggcgccgccgaggtgatgatgttcgccaggtggtcgtggttgtcggtggtgaaggggtaggcggtttcggcgatcaccgtcggcctgccgtaacggtcgcgcaggtcgttgaggaccgacgccagattcgtcaggtccccgtgccacatgcagtagtaggacagcgccgtgacgtcccatcgcacgccctgggccgcgattccgtcgtagaaccagtgcgccgcgtcgatgctgccggcgtccgcggtgtggatcagcacccgggtccgtggatcgcacgccttggccgcggtgtagccggccttgagcagcgacgcgagcgggccgaagtcgctgtcgtccacctgaccggccggccacagcagcccggtgttgatctcgttgccgatctgcacgctgtcgggccgggtggcccggcacacgtcgtacgtgtagtcgtagacgtccttctgcagttgttcgaggtcgtgaccggcccaggcggcggggatgaactgcttgcccggatcggcccaggtgtccgagtagtggaagtcgatgagcaccttgaggccgtgccgccgggcctcgcgggcctgcgccaccacctcggcccggttgttgtagccgctggtcgggttgttccagatgcgcagccggacgtagttcaccccggaccgctggaggatctcgtacgggtcggcccggtgcccgtgcctgtcgtagtacttcgcgccgaggtcctgggcgcggggcagggtggacacgtcggcaccgtgcatggcgaggccggcgtgtggcggggtgggtgggagcaggagggcggcggccagtagtgcggcgaatttcatggcgctcctttgtggacaaagggacgttcatcggtgtggcggccggccccgacctgagggggtcgaggccggccccggtgggggacccggtgaagccgaccggtcaggaacccggtgaggaagcccgcagcacgaggctggtgggcacggtgatggagagcggcgtccggccgttgatcacgtcgacgaggagacggaccatctcctcgctgatccggtccagcggctgccgcaccgtgctgagcggcggttcggtggtggccgccagcccggagtcgtcgaagccgaccacccgcacgtcaccgggcaccgcgcgcccggcgtcgcggagcaccggcagggtggccgcggcgatcgcgtcggacgcggcgaacaccgcgtccacgtccggggcccggctcagcaggatgcgcatggcggccgcgccggtctcccggctccagtcgccgtgcacgatcaggtccgagtcgatcggcaggtcgtgggccagcagcgcgtcggtgtaaccggccagccggtcgacaccgccggaggtgtccatcggcccggtgatggtggcgatccgccggcggccggccgcgatcaggtgctcggtggcgctgcgggcgccggcccggtcatcggccgagaccgagctgatcatctcctccaggccgagcacccggccgcaggccacgatcgggacctgggcctgcaccagctgccggagcagtgggtcgccggagtgcggggagaccagcagcacgccgtcgacgtgaccgccgttgaggaacgcgagggtgcggctgcgctcctgctgggtggaggcgatcatcaggatcagggtctgctcccggtcggagagcgcctgggccacgccgcgcagcagcaccgagaagttcgggtcctcgaagagcaggtgctgcggctcggtgagcaggaaggcgatcgaccccgaacggccggtggccagcgagcgggcgtgctggttggtggtgtagccggtgcgggcgatggcgtcctggacggagcgcaccgcctccgggctcacccagtcgcgcccgttgagcacccgggagaccgtcgcataggacaccccggcctcgcgagcgacatcgcggatcgttgggcgtttgcgcgacacgttcgggatcatagtcggcaccgtttcctaggccttgacgccaccggcggccaggtcgacctgccagtaccgctggagagtgaggaacagggcgatcagcggcacgatcgacaccagcgcgccggtgatcaccgaggtgtacatcgacggctggctggcgccctggttgagcagcccgttcaggccgaccgtgagcgggtacagcttgtcgttgcccagcatgatgtagggaagcatgaagttgttccagatcgcgacgaactggaacaggaagaccgtgaccagcccggtccgcatcatcggcaggaccacgcggacgaaggtgcgccagtcgcccgccccgtcgatccgggacgcctccaggatctcgccgggcaccgcggcggccgcgaagatccgggcgaggtagatgccgtacgggctgatgaagctgggcagcagcaccgcccagtaggagttggtcagccccaccttcgccagcagcaggtactgcgggatggccaggatgaccccgggcaccaggacaccggccaggatcacgttgaagacgaggcccttgcccgggaagtcgaacttggccagcgcgtacccgctcatcgccgagatgaatgtggagacacccgcgccgaccccggcgtacagggcggtgttggccatccagcgccagtacagcccgttgcggtagtcgctcaggtcggccaggttgtcgaacaggtgggtgctcggcgccagggtgaaggtggcgaacagctccccggcgctcttgctcgacgcgatcaccacccagatcaccgggaacaggcagtacgcggcgccgagcagcagcagggtggtggcgatcctaccggtcttcatcagtcctcctggttgaacgcgcgacggccgacgagcttgaggaagccgaaggacagcaggaaggtggccaccgcgatgaccaccgaggtggcggccgcggcgtagatgtcgttgcggacgaacgcgtcccggtacaccttcatcagcggcgtccaggtgaacgagatcgtgttgctcagcggcttcagcgtgatcggctcggcgaacacctgcagcgtcgcgatcagcgagaagacgaatgtcatgatcagcgagggcagcacgatcgggatcttgatccgccaggcgatcgcgaactcggtggcgccgtcgatccgggccgactcgtacaggctggtcggcacggcgcgcagtgcggtgtagaggacgatcatgttgaagccggtgccgccccagaccgcgacgttggcgaccgcgtacagcacccaggacgaggagagcagctccgggggatggatcccggcctgctccagcgcgtagctgaacgggctgacccggggcaggtacaggaagccccagagcaccgacgccacgacggccggtaccgcgtagggcaggaagatcgagatccgggcgaaggcgccgatcgtcggccgggtccgcccggcgtccagcagcagcgccatcagcagcgccaggccgagcatggtggggaccacgatcaggccgtacccgaggatccggtagacgctgggcaggaagtcggggtcggtcatcgaccgggcgtagttgctcagcccggcccacacctcggtgcgtgacctggcacccaggccgaggccgctgaccttcaccttgcgcaggctcagatagccggtgtaggcgaccggggcggccaggaacagggtgaccagcagcaggccgggcgcgaggaaggcgtacgggacgccggcggtgcggttgactgaggtggttcgcgacatcgccgcaaccttccgtggacaggaccggggcggaacgcagggggagcgtcccgccccggcggggggatcagccggcgacggtgaaaccgttgttcttcatgtcgtccacggtggccttctggatggtggccagcgacgcggtgaaggcggccgccttcttcgactcggcggccctgccgaaggcgtcgttgaacgcggagtacgccacgttcacgttcgggccgtaggtgaacggcctggtctgcttggccgcctcacccgcgatcgtgtagaagtcggcctggtcggcgaagaaggccggcggtgtggtgagcgcggcggtggcgtcgttcgcggcggggtacacgttggcggtggtggccagcagcttgatcgcggccgggtcgctgttcagccaggagacgaactgcgcggcttccttggggtgcttactctggctggtcacgctggtcgccgagccaccccagttgccggtcgccgggctggcggcgtcccactgcggcatcggggcggctttccacttgcccttggtgtccttggcgctgccctcgagcacgcccggcgcccagaccgcggagacccagccgacctgggagccgtcgttgagcgcggcgttccactccggggtgtacatcggcttgttgtcgacgacgcccttctccaccaggccaccccagtaggcggcgaccttctgggtggcggggtcgttgacgttgaccgtccaggactggccgttcacgccccaccaggacgcgccggcctgctgggcgaggccggtgaacaggcccgcgtcggtcgccgagaaggtgccgatgtactgctcggcgttcgccttgtggatcttctgggcgtccgcggcgtactcgtcccaggtcttcggggcggtcagcccattcttctcgaagacgtccgagcggtagaagaacatcaacggcccggagtcctgcgggacgccgtagacggcgtccgagcccagggtgacgctgttccaggtggcggccgggaacctgtccttgagcccgccgacctccttggcgatgtcggcgagcgcgtcggcggagaccagagtggggatcttctggtattccgcctgcatcacgtccggggcgccggagccggccttgatcgcggtcagcagcttggtgacggccgggtcgccaccatcctgcttgttgaccgtcacctggatgtccgggtggctggagttccaggccgcgacgaccttgtccatgttcggcgcccaactccagtaggtcagcgcgaccttcccggtgccggtcgtatcgtcagctttgtcgtcagacgagctgcaggcggcgatggtcagcagggccgccgcggtcagggtggccagcaacggggcaagggtcttcttcatgggtcctccttgataggcgcgccgggcggggccctcggtcgatgcctgtgaccggttacagtgctggcgttacgtccgtgtgtcaagcccttgcttccgacccgttacgcctgtgtatcgttcggccctgccagcctgtgaccggttacagtcccaacggaaagaggggtcctcgtgcccgaaccgacggcgccgctctccgtgcgccaccaaccctggacgacgccgctgcgccggccgcggatgagcaacgacgaggacgtccggccgggcgtgtccctcaccaaccgctacctgaccaggaacggcgtcccggtcgtcccggtctccggcgagctgcactacagccgggtgccgcggcaccgctgggccgagcgcctgcgccagatgaaggccggcggtgtcaccgtggtggccagctacctgttctggctgcaccactcgccggcccccggcgtctaccgcttcgacggcaacctcgacgtcgccgcgttcgtcgacctggccgccgcgaccggcctcgacgtggtgctgcggatcggcccgtgggtgcacgccgagagccgcaacggcggttttcccgactgggttcagcaggccccggtccggcaccgcaccgacgatcccgactacctcgcgatggtcaccgagtggttcgaccggatcggcggcgaaatcggcacccgcgagatcctgggcatccagatcgagaacgagctgtacaccgaccccgagcacctgcgcacgctcaagcggatggcccgcgacgccggcctggccgcgccgatctggaccgccaccgcctgggacagcgccgagctgcccgacgaggaggtgctgccgctctacggcggctacggtgacggcttctgggtcgactcggactcgccctgggcgccgaacttccgcgaccactacttcttctcgcacgtctgggacgacccggggatcggcgccgacgtgcgccgcgcgcagaacatcgaggcggccaagggtggcccgcgcaccccgtccgcggagttcccggccgccacctgcgagctcgccggcgggatggcgaccgcgtaccaccgccgcccgctgcccaccgcgctcgacgtggccaccatcgcgcattgcaagatcggcaacgggtcggcctggcagggctactacatgtacgccggcggcaccaacccggccggtccggacggcatgcaggagtcgcacgccaccggctacccgaacgatctgccgcgcctgggctacgacttccacgccccgatcggcgaggccggcgtgctcgcggaaagccacgccgaactccgccgccagcacatctttctgaccgctttcggtcatcagctcgcggagatgccgtccagtctgcccgagacccgcccggacggcgtcgaggacagctccaccctgcgctgggcgctgcgcagcgacggcaccagcggtttcgtcttcctcgcctggcaccagccgtacttcccgctcgacacctaccgcggcgcccgcttccgggtcgacctcggcgagcggagcgtggaattcccctcccggccggtggacatcccggccggcacgctggcccgctggccggtcggcctgaccgtcggcggcgtccggatcgactgggccaccgcctcggcgctcaccgtgctccccggcacggtgcccacgctggtgctgctcgccgaggccggcatccccgccgtggtggccgtttccgatcgggaacacacgcccggcgccgagccgctgcgggtcgagaccgccgacggcgcgctcgacatcctggtgctgccggccgacacggccgcctcgatctgggtcaccgaggccggcggccgccggctcctgctcagcgacgacgaactgcagtgggacgcgaccgggaagatcgtggtcaagaccgctgcgattgccgcggtacgccgttacgacccggccgtccgagccttcgccctcctaccggtcgagcccgcaccccgcccggtcagcgtcgccgtggccaccaccgaggtacgcgccgccaccaccgtgcccgcgtcgtacggcaagcacgacggccgtgcctccgcccccggccgggccgccttcgacgagcacgccgcggtccacgagctgcacctgccggactgggccgccgaccccgagcaggacgccctgctgcgcatcgactgggccggcgacgccggggagctgcgcctcgacggcgtaccggtcaccgaccggttctgggacggctcggcctggcaggtcaacctggtcgacgccggctaccgggccggcgcccggctcaccctgcacctgctgccgttggccaccgtctccagcgtcgcgctgccctcggcggcccgcgaccggctggtcgccgccgggtcccagctgctcgccgtcgacgcgatccgggtgaccggccgccgcgtgacgaccgagcgggtggacgagcacccggtacgcaggacgtcgcggcggatggccgacggccgggagatcatctacttcgacgacgtctccgcgggggtcacccgggaggcggtcgacacccggccgctgccaccggccgaggaggtgctccggggcggggcgcaggtccgctacgaccgctgaccggcgagtggatcgcgatggcggcgcaccgcaacgaccggaccttcatgccaccggccgaccgggacccgctcgccccgaccgggccgggcggcttcccgaccgagatcgccgaggccgactacgacgtggtcgtcttcgagaaccggttcccgtccttctcaccccgcaacgggggcaccgcggacctggtcgacggcgatccgctctggccggtgcggcccgcgaacggacgtaccgaagtcgtgtgtttttcgtcggccccgaaggggtcgttcggcggtctgagcccgcgccgggcccggaccgtgctggacgcctggatcagcgacaccacccccgagcggaccgccgcccgcctgcgccggatcgggtgagcggcccacccggccatccggcccaccccggatggccgggcgccggccgtcagatggccgtccccgcggccccgggacggccgcccggcctggtcgcccggtcggcctccgtctcgtgacgccagacgccggtctcctcgtcggtgatcagcaggggcagggacagctctccccgcacccaccgccgcagccacgacgcgagggagaacccgtgccggtagagagccaggcactcgccggcccgcacccgggcccgcaccgccgcgaaggcgaggtcgtcctcatccgtcatgcggcgatcgtgtcagccgggtctgaccggaaccggcccagggccgccgccgtggccggcggcggccccgggccggctcagtgggagccggtggcggtggtcgagggcgccttcgtgcccagcgcctcggctttgagctgttcgtactcgatccggtcgatggcgccggagtcgagcagttccttcgccgtggtgatctgttcggtggcggtggggccggcggtgcccgagccggcctccgtccggatgtaggcgtcctgccgggcccgggcgtcggcctgggcttcgagggcccgggtggacatgtcgtggccgcgggcgatcagataggtcagcatcccgatgatcggcaggagaatcaggaagacggtccacgtcgtcttggcgccgccgcccaggtcccggctgcggaacaggtcgccgaagacccagaacaggcacatgaaccaggcgcagaagacgaagaactccagggttgccaggaggaacgagccgttgtcgtcgaacacggtggcatctccttcgaaagtggcggtgccggcccctgcagtccacccggtccggcgggtcctgtcctcatccgccgcggatcatctccggggcggatcgccgaacggggtggggatgtgccggacggcgaccggtgaccgctcgtcgtcgttcttctccgaccgccgggggagtttcacggcgtgcggcggcatcggttcgtagggcaccaggctgagcaggtgggtgaggatgttgagccgggcgcgcttcttgtcgtcggtgccggcgacgtaccacggcgcccacggggtgtcggtggcccggaacatctcgtcccgggcccgggagtaggcgtcccacctggtgtacgagtcgaggtcgaggctggagagcttccaggtcttgcgcgggtcgtcgatccggttcttgaggcggcgggtctgctccctcgggctgacctcgagccagtatttgaccaggatgacgccggagtccacgatcgcgcgttcgacggcgggcaccgcctgcaggaactgccgggcctgttcgtcggtgcagaaacccatgacccgttccaccccggcccggttgtaccagctgcggtcgaagatcaccacgtcgccggcaccgggcaggtacggcacgtagcgctgcaggtacacctgggaccgttcccggtcggtgggggccggcagggcgacgacccggaacacccgggagctgacccgttcggtgatcgccttgatggtgccgcccttgccggcggtgtcgcgtccctcgaagacgatgcagatcttggcgccggtggtcttcacccagtgctgcatggcgaccagttcgccgtgcaggtggcggagttcgcgctggtactccttctcgctcatccgcggtgtgcccgggccggtcgcggcccggtgatcgctgcgcggtgcctgcttggtcatgtgctcctccgatgacgcggccgtggaggtcatggtggggaccgggcgggggatcgctcctcatcctgggcgggcgaatcggccggcgctcgaaacggacagtgcggccgcgggcccggtagtagggtccattcatgggcgttgatcgacctattgacgtcgctgacccggccgcggtgcactacgacgacgaggagcggccggcccgggagctcaccgggcgtgtcgcgctggcggtcgcggtggtcgcggccggggccggggtgctgacgctctggcaggtgttccggccgctggcgcagggcagccagttctacctgatcgtctttctggcggtgacgctgccgctgatcttcgtcgcctaccgggcgcgcgccgcgagtccggggcggccgagccggctggactgggtgctgggcgggctggcgctggccgcctgtctctatccgctcaatccgttcggcggcggctacgacgctttcctcgaccggcaggcgctgctcgaaccggccgacgtcgccttcggcgccgttcttctgatcacggtgctcgaggccgcccggcgcaccaccgggttcgctcttcccgcggtctgcgccggattcctggcgtacggctactacggcggcctgctgccccagagctggccgatcgcgcattccgggctggacttcgcgcagatcgtcgacgccctctacaactcgggcagcggcttctacggcaccccgctggacgtggccgcgacgtacatcgtcctgttcacgctgtacggggcggtcctggacctgtccggggcgagccggttcttcgtcgacctgtcggtggccgcgttccgccgctcgcgcagcgcggccgggcggaccgcggtggcggccgggttcctgctcggcacggtgtccgggtcgggaaccgcgaccgcggtcagcgtgggggcggtgacctggccgatgctgcggcgggccgggtatccgccggagcaggccggcgggatgctggcggcggccggggtgggcgcgatcctgtcgccgccgacgctgggcgcggccgcgttcatcgtcgccgaatacctcgacgtgtcgtatctgaccgtgctcggctgggcgacgatcccgacactgctctactacctcgggatcctgctggcggtggagatcgacgtacgccgcttcggggtgcgtgccgtcgatctcccgcaggtcggtgccgggcggctgctgatccggttcggctaccacttctcctcgctgatcgtgatcgtggtgctgctcgcgctcgggacgagcgccacccgcgcggtggtctacgccaccctgctcgcggtggccctgtcctttctggaccgaccgggccggctgaccccgcggcggctgttccaggcgttggcggccggggtgcgcggggtgctgccggtggtcgcggtatgcgccgcggccggcgtgatcaccgcgatcaccacgaagaccgggctgggcgcgcagctggcgtcgctgctggtcgacggcgcccggtcgatcaccggcaacccggccgcggtgctggcgctgaccgtggtgctggccgcggtggcgctcgccgtgctgggcctcgcggtgccggtcaccgccagcttcatcatcggctgggtgatcatcggtccggcgctgctcgggctcggggtcggcgccccggcggcggccatgttcgtcttctactactcggtgctctccgaggtcaccccgccgaccgcactggccgcggtcggcgccgccgcgatcaccggcggccgggcgatgggcaccatgtggcaggcgttgaagtacgcactgccggccttcctggcgccgatcgcgttcgtgctcaccggcaacggtgaacatctgctggcccgcggctcctggccgggcatcgtggcgaccgcggtggcgtccggcttcgccgtgttcgggctggcgatcgccaccggcggctgggtgccgggagtcggcccggccggcccggcgagccggctgctgggcggggtcgccgggctgctgctgctctacctctcgtggctcgcggtgagcgccggcctgggcgtgctggcggcctcggtcctgctcgcggcgatcgcccggtggcggtcacgagccgagcccgccgtgccgccggatacggaacctcgacattcacggaggatcggagggaaccgatgagacggatcatgaccgcggcgtcgatcgccgcgctggccctggccgccggcgcgtgcggcggccggcagcacaccgcggccaccgacaccggcggcgacgtcacctgtcaggtcgcccggcagacccggatcgggatcgccaccggcaacgccaccggggtgtacttcgcgctgggcaacgcgtacgccgagcagatcaacgcggccggcggcagggtgcaggcgaccgccgcggagaccggcgcctcggtgcagaacatccagcagctggtggccggcacgtacgacgtggcgttcgcgctggccgacaccgcggccgacgcgatcaacgggacggccgccttcagcgcgaagcagccgatcgcggcactggcccggatccacaccaactacacgcaggtgatcgttcgcaaggcggccgggatcagggacgtcgccgggatgcggggcaagcgggtctccaccggttcgccgaagtccggcaccgaggtgatcgccaaccgggtgctgaccgccgccggtctcgacccggccagggatgtcagcgcccagaagctcgacctgaccaagaccgtcgacgggatgaaggagggcaccatcgacgcgctgttcttctccggcggactgcccacgccgggcatcaccgacctgctgaccaccgcgcgggaccaggtggagttcctcgacatcaccccggtcctgccggccctgcagaagatcaacgaggtgtatcggcagggggtcatcccggccgcgacctatcagcagccggccgacgtgacgacgatcgtggtgccgaacctgctgctggtgcgcgccggcctggacccggacgtggcctgcgtgctgaccaggacgctgttcgaacggcagccgcaactggcgcaggcgaacgcggcggcccgggagatcagcctggacaccgcgcgccggaccagcccggtgcccctgcaccggggggcggagaaggcactcgacctgctgcacgcgccccggtgaggcgcgccacggtgcccgctcacgtcgtacccccgcaatcgccgcggtgaccggccgcggacagggaggaaagccgcggtccgggcgggttttccggtgcgtgcaaccctgacgggcggccgcctcgtgtttgacgcgaccgaaaaaacgatgggggaatgcatgagcgaccgtgacgaggcgttcgcggaatacttcgcggcccggtcaggcagcctgcgcgccaccgcgtatctgctctgcggcgactggcatcgggccgaggatctggtctcgaccacgttcaccaagctctacctgcggtggggccgggtgaaccgccaggagtcgctggatccgtacgtccggcaggtgctgatccgcaccttcatcgacgagggtcggtggggctggtggcgacgggaacgcccgcacgacaccctgaccgaccgtcccgtcacgcccgcggtgcagaccgaggaccgcctggtcctgctgcgggcgctggccgaggtgccaccgagacagcgcgcggtgctggtgctgcgctactggcaggacctcagcgtcgaggagacggcggcggcgctcggctgctccgccggcacggtcaagagccaggccgcccgtggcctggcgacgttgcgcgcgctgatcggcgcgcccgtgacggctgattgaggggaatgatggaggagaacgaattccgcgaggcgctgcacagcgtgctggcgcagagccccgaaccgccgccgatgcggtcggccgaggcggtcgcggccgggcgccgggcctcccggcggcgcaccgtggtcgcctgcaccggggcggtcgccgcgctggccgcggtcaccatcgtgccggcccgctacctgtccgccgcgacgtcccccaccgggtacgacgccgcggcgccggccggcacgcccagcgtgctgaccaccccgccgccgagcggggtgccgtccccgcaggacaccgaaccgtcctggccggccgagaacaacggcgacgccacggccgacagcgggccgcgctaccagaagggcaggcaactgctcaccgacctgctcaaggtggtgccgtccggatacaccaccccgaccggcaccacgccggacggcagcgacctgcagtccagccaggccgcgctcgacgatccggagtggacgtacctggccagcgtgaccgtggcccagggcggccacaacggtgagctgatggtcgaggtgcacgagaagaacaacaggctgcccaccgacccgtgcgggttggccgagtcgttctgggggctgggcggcagttgccaggtggtccgggacgggccggcgaaggtcgcggtggccaggtcgaacggcggcggcgacaaccggatcgaccagtgggcggcgtaccgttatccggacggggtggtggtgttcgtggcgcagaccgggcgacccacctacgccgacgcgcgcgcggcgaaactgaacccgctcccgttcaccgccgacgaactcggcaagctcgcgctcaacccgcggttccacctgaggtagcggcggcggcgccggtccgggggctccggaccggcgccggaagaatcttggcgacggcctgaacggttccgcaccgccggcggtacaccccgatgacagcagctcccacacctgaggggagaccgggatgaccgccgtgacccagccccgcatcatcaccttccgtcgatctatccgcgtcgcgcgggtcgcgatcgtcgccttcctcgtgctcaacgtcgtcgtcgtccaggtcatgttcgccgcggccggcccggcccggaacctgcccggcacgatcggccggctcctcggactccacctggccctcgcgctcgccctgcaactgctgctggtcgcccgcctcccggtcgtcgaccgggcgtacggcatggaccgcctcaccacctggcaccgctggaccggcctgacgatcttctggctggctctggcccaccccgcgttcgtgctgctcggcttcgcccgcctcgaccgggtcccgatcctcgacgagacggtcaccctcgccggccagctgccggtcctgctgggcatgatcgccgtcggcctgctgctcgtcgtcgtcggcctgtcgatccgcgccgcccgtcgccggctctcctacgagacctggcacttccttcatctgctgatgtacgtcgtgatcctgctcggcgtgctgcaccagctgtccgagggcaccgcgttcaccgtcaacgcgttcaccgaggcctactggtggggactgtgggcgttcgccctgggcgcgctgctcgccggccgcctgatcgtcccgctgatccgcaacgcccggcaccggctgcgggtcgccgccgtcgtcgacgaatccgcggacaccgtctccgtccacatcaccggccgcgacctggaccggctcgacgcccacgccggacagttcttcctgtggcgtttccccggccacaacccctggtggcaggccaacccgttctccctgtccgccgcgcccaactcccgatcgctgcgcctcaccgcgaaaggcgtcggcgccaccagcgccggcctgcgcgacctgccgcccggcgcccgggtgtacgccgaaggcccgtacggcgcgttcaccgccgcccaccgcacccgcgccgccaccgtcctgatcgccggcggcatcggcatcaccccgatccgcgccctgctcgaagaccccgagctgaccggccacatcatcgtcctctaccgggtccgcaccgcgaccgacgccgtcctgctcggcgaactgcgcaacctcaccgacacccggcacgcccggctgcacctgctcgccggccgcagcggcaccggctaccggccgttcgccccggaccgcctgaaagccctgatccccgacatcaccgcccgtgacgtgtacgtctgcggccccgacgcgatgaccaccggtgtcctggacagcctgcgccggctacgggtaccggcccgccaggtgcacgcggaacgcttccggctcgccgggtgagaagcggggggccgtccggacgatgcccccgggcggccccttcgggagagtcccgggtgctgcctcggtatgggggaggcagcgcccgggacttcgtccgtgcccggccggccggatccttgtcgggcggctatccgccggaagtcggatcaggatcgatgaacatcggccgaaggccgggtccgtcccggccggccggaacgtcatcatgctggtatgcccatcacgacagaggtgtaccggcgcgcgaccgaaacggtgaccgtcatggcgtccatcgacgacgagggagccgagatccgcgtcatccacgaacgcgacggcgaggtcctcaccgacacgatcccggagtggggcgacgacccgcaagcgggacggcggtgggtggcccggcatcgcgaggcccgcctcgccgagggctatcagctcgccgaggagaccgagggcccgccccggtagcgggtgtcccgcgcgccggcggagcctcactccgactggaccacggtgaagggtggccgcacgccctcggtgaggtcggcggccgcttcgagggccatctccgcccgttgccggctgctgatcggggacttggcggtggagtgcagcgagcccagggcgaccaggtagccggatccgaccgcggcatagccggagatggtgtggccgatctggtagtcggcgtcgacgacgtagaggcggccgtgaatgccgaccaggaactggccaccctgctcctggccgttctcggtgcgcgcgtagccgcccgtggagaggcactcgcggacggcttcgatgaacgtggtgaccatgaaccggtcgacgtcccaggtgtcgggttcaccgacggccagcgagtagcgcagcagctgacccatccggtagctggtggtgaaacccatcaggtagggccccacctggaagaccttggagtccgaacggacggcgacgtgccagccgtcgctgcccgcggagtccccgccgatggtgacggtccgcccgtccgtgatcccgacgatgcacgtcatgacgacactcttcacggccggcagcccggtgccaaccgtgatcggagaacgcgatcacgccggcagcgcgtcgacgtgtcggaggattcccgccgccgacggcacccggctgctcaccgtgcacccggcacaggtgaggagacaatggagcactggccgcctgtacgaacacctgcggcccaccctcactctcgaccggatcatgcccgccgacgaagcggattcctggctcacccgagtccagcccgcccgcgaacccgacatgttccaggtctagaccgatggagatcaccggacggcacggcgcatccgcgagccggcgcacgcggcgcggcgagcatcgctgcatcggcaggtcccggtgcgggttcgccggctgatgcccgctggcgcccgggccggaaatccggtcgcgggtgagcggggcggcggggaatgatcggcgcgtgagtgcgaggttgcgggcgatcgcccaggagacggtggggatcgcggagcgcggccactacgacgggccggacgggcgggtggagatcgccgggcaggtggcgcgggcggtggcggggacccggctgcacctgcccggggaggacctgggcgagccttccgtcgacaacccggcgccgctgatcgagatcaccggggagtcgacgctggtggcggcgcggcgggccggtggggttccggcggtgctgaacttcgcttcggcgcggaatccgggtggcggcttccgcaacggcgcgcaggcgcaggaggagagtctggcccgcgggtcggcgctgtatccgtgtcttctcgcggccggcgagttctacgaccatcatcgggccgagcggtcgctgctctacaccgaccgggtcatctacgcgccggcggtgccggtcttccgcgatgacaaggggcggctgctgtccgcgccctatccggtgtcgttcctggtggcggccgcgccgaaccgggcggcgatccggttgaaccagccggagcacctgccgcgggtgcggccggtgctggcgcgccgggcggcccgggtgctgcgggtcgcggccgcgcacgggcaccgggatctggtgctgggggcgtggggctgcggtgtgttcggcaacgatccggccgaggtggcggcggcgttcgccgaggcgctgcgggcgagcccgtggttcgaccgggtgatcttcgcgatcctggaccgggacgagagggtgcgcgacgcgttccgccgggcactgccaccccgctaggaggcgcgctgcgcgcccggcttctccggggctcagatccgcggcgggctcccggtcagagcgatgcgccggtacgccggcgggtggcgccgaccggtgcgcaccacccggggcggcggggtccgcgggctggggtggctcatgcgtaccgccgccatcgaagcggcccgggccgtcggggacctggccggtgcggcgctcagcaggcgccggaggttgccgaatcatctgatatgaagcggttctgggcggatctcagcgtcaacgtcaagatcatggcggcgatctgtgtcgccgcggtgatcgccctggtcatcggggtgaccgggctgagttcgctgaaccgggccagcaacaccgcggacgagatctactccgacaacgtgaccagcgcgtcagtgctggggcggatccagaccgcgatcaaccaggctcggctggacctggtgaaccacgtgatctacaccgacgccgcgaacaaggcgaagtatgagcaggagatcacgaccgacttcgatgacgtcgccacggcgctcaaggattacgcggccaccgatccggccggcaccccggtcatcgtggccagcctgaacgacacctggcagaaatatgtcgacgtcgcccagagccagctgatcccgctgtcccgggcgaacaaggtgacccagtggcagcaggtccgggccgatcaggtgttaccgctggtggatacgatcaaggcgaacctgggcgatctcaacaaggcggaacgggccgacgcggaaagcgccgcggagggggcgcgcacctcgtaccggcagaaccggctgcagcagatcgtcatcctggtcgtcggcatcgtggccgccctgctgctgggcctgatggtggcccggggcatcgtgcggtcgctgcgccaggtgaccgcggtgtgtgaggcgctcgcggccggcgacctgacccgcagcaccgggatcacctcggccgacgagccgggccggatgagccgggcgctggacgccgcggtgcagcggctgcgcgacgcggtcagcaccatcggcgagtcggcggtcaccctcgccggcgcctccgaggagctcagcacggtcagctcgcagctgcagagcggcgccggcgacgtggcgcagcaggccacctcggccagctcggccagcgacgaggtcaacgtcggcgtccagtcgatcgcggccggtgccgagcagatgagcgcgtcgatcaccgagatcgcctccaacgcggccgaggcggcgcgggtggccaacgaggggatgagcgtggccgagcgcaccaaccagcaggtcgccgagctgggcgcggccagcgccgagatcggcgacgtggtccggctgatcacctcgatcgccgagcagaccaacctgctcgcgctgaacgcgaccatcgaggcggcccgggccggcgagctcggcaagggcttcgcggtggtggccggcgaggtcaaggagctgtcccagcagaccgccaaggcgaccgaggagatcaccgcgcggatcaccgcgatccaggcgtcgagcacctcggcgaccgcggcgatcggcgagatcaccgaggtgatccagcggatcggcgactacaccacgacgatcgcgtcggcggtcgaggagcagaccgccaccaccggcgagatgagccggtcggtggccgaggccgcggccggcagcggcgaggtggcccggaccgtcaccaccgtggcggaagtggcggccgccacggccgagggggcccgcaccacgcagcaggccgcggcagacttgacccggctggccggcgatctgaccacgctcgtcggcggcttccgccactagcccgggggtgtcatgagaaccgatctctacgaccgtctcgccgatcccgcccgtctgatcgagctggcccgctacgacctcggctcggaccggctgcgcgccgccctggacgaggtggcccagcgcagcgccaaactgctggacgcgccggcctcgctggtgtcggtgctgggcgcggacgcccagcagatcatcggggagtacgggctgggcgactgggtcgcggtggcgcagggcgcggccgccgagtgggcggtgtgcagccggaccgtgctgaaaggcgagccgtactgcgtcgccgacttcagcgacgacccgcagtacgcggccaacccgttcctggccaccgccgggctgcgcagctatttcggggtgccgctggtgaccccgggcgggctgatgctcggggcgcactgcgtggtggacacccggcggcgcatctacaccggggtggacctggcggtgctcagcgacagcgccgacgaggcgatggaggcgctgctgcggcaccggcgcccctagccgctcagcgccgatccgaccgccccggccctggggcgatgccggggtgcagctgcgatgcgaaggcgcggagcagtgatgtcccggtccaccgctctgccagccggctgtgcaggccgcgcagctcaccggtgatcgtcgaccggccgctggtgggggcacgccgtggcgatcgcccggcggccgagttgcctctgcatacgaccgccgagttgcgcgaagtgagcggcggctgccacccgccctggctctgcgtcccctgcggggcgctccgttacggtggcgccactggctcggatggcatccggacagcccggcggcctcctctgcgacacgtgtgttcggcttcgccatcgccacccatctggagactctgcgtcgcgatcccgggtatgcgggatggctgcgggcacatgcggaaccgggtgccggccggccggcctccccgcgccgtctgccgcgtcgcgacgccatctccgcttcgcgcggtccccgccgcgggctgacggtttccttcccgcggcggcgtcagcttctttcccacggcggcgtcagccggactccctaggcgtgccaccgccatgcggtccggcgggaccggccgggcagctcgatgcggccggtgcaccagagcagggcgggccacggctcgtggccggccggggcgtccgggaagatccgggccagcacccgggccgacacgcccggatcgggggtccagtcgaacttcagcgtcgccgcgatgtcgtgcaggtggaccaggacctcggtgatgcccatcgcggcgaacccggcggcgtcggacaccccgaacggatggaagccgcgccggtcggccgggctcacctcgacgaccgcggcgagcaggccgccggccgcctccaggacccgcaacaggccctcggtgccctgctcggggtcggcgtggacggtcagcgcgggggcgtccggccgggacctccgccagccccacgcgacgtaccggtcgaccggcggccggtcggcggcgagctggccggcgtaggcgaacaggtcgtcggcgacgtgctcgaccgtctcccagcagctccaggtgagatcgccggcagtggtggcgtgccagtcctcggccgcgacggtgcgcagcgcggcgaccgcccgccgggtcacggcgcggacgtcgccggcggtggggaagtcctctgtcgtcactccggggacggtagccgaaaagtgtcataccccgcgcgcatcatcgggacatgggagaacccgcaacgccgatccgccggcgcatcgagctgtccatcgccgagacccgcctgcgtttccagcagctggtccggctcaccggcctgaccggccaggtgaccgtggtggtcgacggcggccgcccgatcgccgccatcgtcccggccgccgacgtgctgcggccgccgtcaccgcccgatccgcccggccggtccggggcgggctggctgcagcgcatcgagaaggtgcgcgacgacgtccgccgccagcacgccggccggatccaggagctgtcccaagccttggacgaggcgtggcagatgctggaccagcggcatccgccgggcaccgaccggcacgtcgacgcgctgcgtgcggcacagagagacgtgcgccgcacccggtgatcaatcaccactgcccctatcgggacggaggtaagatcggccaatggcgcgccagctcgatctgttcgtacccgggatggtgttcctcgatgtcatcttcaccggcctgcgggagctccccgggcccggcaccgaggtgcgcgcctccgggatgggctcgtgcccgggcggggtggcgaatctcgccgtcgccgccagccgcctcggcctgcgcaccggcctcggcaccgcgctgagcaccgacgcctacggcgaattctgtcaccaggtgctcagccggcaggagggaatcgatctctccgcatcccggcggctggacggctggcactcgccggtcaccgtctcactggcctacgaccgcgaccgcagcatggtcacccacgagcatccgctgcccaccgacgacgagggcctggtcaacggcctgcccccggcgctggccgcggcggtcagcctgggcggcccgggcaccggctgggtgccccgggcggcgcggaacggcacactgatcttcgccgacgtcggctgggacgagaccgaccagtggtccttcgacgcgctgtcggtgctgcccgactgccacgccttcctgcccaacgcggtcgaggcgatgcgctacacccgcaccggcacccccgccgaggcgctcgacaaactggccggcctggtgccgatcgtggtggtcaccgacggctcggagggcgccctcgccgtcgactcggccaccggcgaggtcgccaccgtgccgggcgtgccggtcgaggcgctcgacccgaccggcgccggtgacgtgttcaccgccggcttcatcaccggcaccgtcggcggctggccgctcgccgaccggatcgccttcgccaacctggtcgcggcgctctccgtgcagcacttcggcggctcgctctcggcgcccggctggggcgacatcgccgactggtgggaggtcacccggttcgccgcgcagagccggcaccccgagtccagcgagggcgagttggcccggcgctacgcgttcctgcccgaggtgattccgcccggccggcgcaacgccgtgcatcgggccaccgccaccatcgcccggctctccgacgcgcatgccggctgaccgtcgcgacaccctggccgggtgggcgttcctcgcgcccagcctggtcggcgtcggcggtttcctgctgctcccggtcctggtcgtggtgggcatcagcctcacccggtgggacctggtcagcccggcccgctgggcggcgctggacaactactcctcgatcctcaccgacccggcgttcggccgctcactcgccgtcaccgcggtcttcgtgctgctggtcatcccgctgcagaccgggctcgggttggccgccgcgctgctgctcgaccagcggttgcccggctccaccgtcttccgggcgatcctggtgctgccgtggatcagcgcgccgctggcgctgggcgtcgtctggcgctggctgctcgacccgtccgacggcgcggtgaaccagctgctcggccaccgggtcgagtggctgaccagccccgccctggcgctgcccgcggtcgccgcggtcaccgtctggaccaatgtgggctacgtggcgctgttcttcctggccggtctcgccgggatcccggcgcagtacgccgaggcggcccggatcgacggcgccggcccgtggcaggcgttccgccggatcacgctgccgctgctgcggcccaccatgttcttcgtgctggccaccggggtgatcaacagcttccaggtgttcgacacggtgtacgcgatgacccagggcggcccggccgggcgcaccgaggtggtggcgtacgcgatctaccgggaggcgttcgtcgacttccggatggggcgcgccgcggccatgtcggtgctgctgttcctgctgctgatcacggtcaccgtggcccagcagtcgtatttccgccgccgcacgacctacgaggtggggtgaggatgcgccgggccgtgctcacctatctcgcgctggccgccggggccgtgctgatcctcgctccctacctgatgagcgtgcagacctcggtgaagaccgcgcggcagttcgcccagcagccgccgctcgccccgcccgacccgccgaccggggcgaactacgccgagctgatcgtcggcgggcacaccctgatcccaccgctggtgatcaccgtccaggtggtgctgatcgtcgtgatcggacagctgacctgctcggtcctcgcggcgtacgcgttcgcccgcctcgacttcccgggccgtgacgcgctcttctggctctacctcgccaccctgatggtgccgatcgtggccgtcctggtgccccggttcgtgctgctcagtcaggccggactgaccgacacgttctggggcatcgtgctgccctcgatgttcggctcaccgtatgcgatcttcctgctccgccagttcttccgggccgtcccgcaggagctgctggacgccgcccggatcgacggcgccggccacccgcgggtgctgcgccacgtcatcgtcccgctgagccgcccgatcctggccaccctgctgatcatcacggtggtcacccactggaacgacttcctctggcccctggtgatcaccagcggggtgcgctggcaggtgctcaccgtcgcggtcgccggcctgcagagtcagtaccacggcaactggaccctggtgacggccgcgaccacgctcgccaccatgccgttgctgctgatcttcgcgatcttccagaaacacatcgtccgatcgatcaccatcaccgggatgaggtgaggctcatgcgacggttcctggcgttcctgatgatcctggcactggccggctgctcggtcgccgacaccggcgacagcggctccggcaggacgacggtcaccttccggctctgggacgaccaggtggccgaggcgtaccagcagtccttcgccaccttcgagaaggcacaccccaccatccacgtcgacgtgcagctggtgccctgggccgactactggaccaaactgccggccgacatcgccgccggcaccgccgccgacatcttctggaccaacacctccaatttcgggttgtacgccgacaacaggcaactgctgcccgtcgacttcaccggggactggacgaaatccgtcgtcgacctctacacccggggcggcaccctgtggggcgtgccgcagctgtgggactcgatcgccctctactacaacaaagacctggtcgccaaggccggcgtcgatccggccacgctcagctgggacccggccgccgccgacgacccgctgcgcgccgccgcccgcaagctcaccgccgcgaacgcgttcggctacaacgccgccttcgaccagcaggcgatcctctgggacttcgtcggttccaacggcgggacctggcagtccggcgacaccttcgacttcgccgaccagcccaggacggtgcaggccgtgcagtacgtggtggatctgatcaacaagtaccacgtggccccgtccgcggcggacaccaacaccaacggcgacaagaccacccagctgttcacccagggcaaactggcgttgttccaatccggaccgtacaacctgaaggccatccagcagggcgccggcttcccgtgggggatcgccccgctgccccagggcccggccggacgggtcagcgtggtgcacggcgtcgccgcggtcgcctccgccaagaccccgcaccgggacgccaccgtcgaggtgctcaagtggatcggctcggccgacggccagaaaccgatcgccgagggcgggtatgcgttccccggcgtgaccgccgcgcagcccgccttcgtcgactactggcggaaacggggcgtcgacctgaagcccttcctggacgcggcggccggcaccaccttccccgcaccggtcggtccgcgcgtcggggcgggtggcaccgcgtacacgccgatcctgcaacagatcttcctcggacagaccggcgtcaccgacggcctgcgcaaggcccaggacgccggcaacgcggcgatgaaaggctgacatgcggttagtgatcctcggtggtggcggattccgggtgccgttggtttaccgggcgctgctggccgaccaccggcagaccggcatcaccgaggtcgccctgcacgacgtcgaccccggccggctgcacgccatcggccgggtcctgcacgccctcgcccgcgacgtgcccgacgccccgaccgtgcacaccaccaccgacctggacaccgcgctgaccggcgccaccttcgtcttctccgccatccgggtcggcggcctgcacggccgggtcgtcgacgaacgcgtcgcccgcgccgccggcatcctcggccaggagaccgtcggcgccggcggcatcgcgtacggcctgcgctccgtcccggaatcgctgcggatcgccgagcgggtggcggccgtcgccccggatgcctgggtcatcaacttcaccaaccccgccggcctggtcaccgaagccatgtccggcatcctcggcgaccgggtgatcggcatctgcgactcgccgaccggactggtcgaccgggtgctccgggtcctggacgcccccggcgcccgggtcgactacgccgggctcaaccatctgggctggctgtacggcgtgtacgacgcggctggtcgcgacctgctgcccgggctgctcgccgacgaggcgggactggccaccatcgaggaggggcggctgtttcccgggctgcgcgaactcggggccatccccaacgaatacctgcactactactaccacccggtggcgaaggcggacgggccgaccaggggagagttcctggctgagcagcaggaacgctgctatcgggagatgtccgcgggggagccgctcgaagcctggctgcgcgcgtggcgggaacgggaagcgacgtacatggcggacaaccggtcgcagagcggggcgggggacagggaccacgacgaatcccggccggccggatacgagggggtggcgctggcggtgatgcgggcgctggcccgggacgaaccggcggaactgatcctgggggtgcgcaaccggggagtgctcgacgtgctcgacgccgacgcggtggtggaggtgccgtgccgggtcgacgggacgggggcggtgccgcgccgggtgggggcgttgcccgggcatgcggtgggactggtgcagacggtcaaggcggtggaacgcggggtgctggaagccgtgcagaccgggtccgcggcggcggcggtgcgggccatggccgggcatccgttggtcggcgacccggagctggcggggcggttgatcgcggcttaccgcgctgagctgccggagttggcctacctgtcctgaccggcggatgtctccgccgccggtgcgcagtccccgcccacccaggggaccggcccccgtccaggacagggcgatctgacgggctcgatttcggcctgtggacgactcggcgggaccgggttgtcccgagatcagccaccgctgcacgacggcgtcgagaggcgctgtcggggagttcggtccggcgacccgcacgccacggctcccgtcacccggcccggtggcgccgacctgctggatcccgggttttccggtcccgcggcacggcaacgggagccagccgcggggcggggtcggggcgtgggcggcatgatgctgtcgtggagcaacggtgggccgagctggcacgaaccctgcgagagctggggcggtggcagcacctgtccggggacgccgccgccgaggcggagcgggcggtggcggcgggtgggtatccgttcggggagagcggcggggatcacgacgtccggcggttctggctggacagcgaaaccatggccgagggcggcgtcggccgggtgctgcgggagatggcgccggcgttgcggacgcacggtgtcgacctgcgggtcgaggtggtgactgtgccgctcaccggggccggcgaaggtgactacatcgtgtcgatcaacgggcggcggtgtgcggcctggacccgggcggaccgggcggctgactgctggtgggaatcggcgacggtgcggccactcgcggtcgtcaacgatctgctggccgaggcgggcgcgagggtacggctgttcgcgctgtacgtggggaccgaggacgcgcttgcctggctggtcgatccgcggatcgtcgcggcggtggccgacagcggtctgttccgggagtccgacgtgcccctgctcgccgcgcacgacaccgtcgagcaacacttcctcaagcgtgggtgacgaactggaagatcctgccggttgtcaggggctgcggggtgccggtgaagcggtgcacgccgacggagaacagcacgtcctgcggggcggtgaaggactgctcggcgaagccggcgtgggtcagccagccgcggatcgccggtgtcaggtccggtgctcgtcgtgagcgggtccagatcaccgtggcgtccggcgcgcagagccggggcagcgcgagaatggtgcggtgggtgtcggcgtcgctgatgttgcccaggacgcccgccatgatgaccaggtccgcgggggccgcgtcgcggtacgaggcgaggtcgccggcgtcggctcgcacgatgctcacggtggcgtgggcgggcacccggctgcgggccgcggcgacgttgcgcgggtcgtactccaggagggtggcggtgacccggccggcgtccgggcgcgacgccagcacggtgaggatgtcgtcgccctggccggcgcacatgctgagtacggacaccggctcaccgggccgctcgtcgagccacgcggcgatgtggtgccggaccagtctcagccgccgggacaggggtgagcccgggtcggtgtagcgggtgtgccaggcgtgccagtcctcaccatcgttcatggacgacagtctgcctggccggtacgggtgatcagggcatagctctggctggcggccaggatgccgaggacggcgcgggccaggttcgccggtgcgccggtggtgggcagtccggtggcgtcgagcagagcggtgatgccgagccagaccacggtcgcggagagggccgcggtggtcagggcacggccgtggcggtggtcggcgttgctgtgcagggcgccggtcgaccagacgatcagggtgacgtcccagaagctgatgacggggtggcccagggcggctaccaccagggaggcggcgagggccagccccgcaccgatcgcggcccggcgcagggttgtccacccggacacggaggcggcgccggcagcgacgtgggagaccatctggagatcctgggtgtcatgagtttctttcatatggacgggaagtgaacagcggggatggatctccagcaccgaggcgcgcgggtgggcgggggtggctgtctcgccacgatggcgctgctgatccatgtcggtcatgcggcgcggctctcggtggcggggcagcgggccgaggtcgagtggggggatactggcctcgccgaacggggtgcacggctgtcggtctcggtttgtccgaaagcgggggcggggatgacggcgagtgatgtggtgcggctgctgaccggcggggagttcgacgagctggagcgccggttcaccgcggagatgcgcgccgtcgtgtcggcggagaccgtccgggtggcgtggacggtgcagaccggcggtgttcccggcgagccgggcgaaccggtcggcgagccgttcaccggcgacctcacccgctggcgcgtgccggtccgccatcccgccggcgacttcgtggtggtgatgtccctcgatgcgggcgggcggctgcacgggctgcggctcgccgccgatgcgggcccggcctggcagccgccgcgatacgtgcgcccggagcgtttcaccgagcgggcggtcggggcgcacggtgcgctggtcaccccgtccggcaggagggtgtcgaccgcggcagtcgttctgccgggcggcggggagcaggaccgggacggcacccacgggcccgacaaaccgctcaaagacctcgcgtggggcctggccagccgcggcatcgcggtctttcgattcgacaaacccgggcctgaccgcacgctggtggaggagtacgtgacgcccgcggcgcaggccgtgggcgagatccgggccgccgtgccgtcggtggagcggatcttcctgatcgggcacagcctgggtggcaaagtggcgcccagggtggccgcggccgtgccggagatcgccggtctggtgctgctcgcggccgaggcgatcccgttgcagcggtcggccgagcgggtcacccggcatctggccgcgcgtgatccggggccggccgccgacgcgatgctggccgcgatgcaacggcaggtcgcgctggtcgacgacgggctgacggcgcagactccggcggcggatctgccgttcggatttcccgcttcctattggcttgatctgcgggggtacgacccggtggcgaccgccgtggccctgcggcgcccgatgctgatcctgcagggcggccgcgaccatcaggtgaccgtcgcggatgatctggcgcgctggcgggccgggctcggcggtcgtcgggacgtgaggttccgcgtgctgcgccgggccgaccacatgttccacagcggttccgggcgcgggccgcggcacgtcgacgcgtcggtgatccgcggaattcatcgatggtcgcgtctggcgctgggctgataccgccgagtaacctgcgggaaaccttgggggtgccgcgtgccgcacgtcgaagtgtccgccgggaccatcgtcacgatcctgggcctgctggtgctggtggcgcagcccggcgcgatcccgttcgcctacgcggtgacgacccggcacgtgaggcggggtggcacccggccgaccctggcggcgatcgtcggctacctgctgggctgcctgttcacgctggtgtgtgtggcgacgttcgcctgctcggacttcccgtggctgtgggcggcgctgctgggatacgtgcccatgtggctgttctcggtcctgatcctgcgacagcccgagatcagcccgggcccggtcgtgcggaccgggcccgacggaagatgatcaggcggtggcgggctcgaccgccgggaagcgcggcgggatcgcggggttcgccgccggcatcggcttgcggttgggcagcgacagccggatgaccttggcccacgccgaggcgacctgcttcgggaacggcccggtgacgtacggcaggtcgtacttctcgaaaagggccttgaccttgaccgcgacttcggcgtaacggctgctcggcaggtcggggaagaggtggtgctcgatctggtgggacaggttgccggtcatgacgtgcatcagcttgccgccggagatgttggccgagccgagcatctgccgcaggtaccactcgccgcgggtctcgcccttgatcgaggtgcgctcgaaggtggagacgccgttcgggaagtgaccgcacatgatcaccgagtggctccacacgttgcgcaccacgttggcggtgaagttcgcggccatcgtgtgcaggaacgacgggccggacagcagcgggtgcagcacgtagtccttgagcgcctggcggcggatcttgcggccgaccgccttcacgttggcccggaactccgggttgttgcgccgcttcttggtcttcaggttgctgccgagctcaaggtcgtacgcggcgatgccgtactcgaagaagagcgcgttgatgaagttccacagcggctgggcgaggtagaaggggtgccagcgctggttctcgtcgacccgcatgatgccgtagccgaggtcgttgtccttacccaccacgttcgtgtatttgtggtgcacctcgttgtgcgagtgctgccactgcgcggccggggtggccatgtcccactcccaggtggtggagtggatcttcgggtcgcgcatgaagtcgtactgaccgtggaggatgttgtggccgatctccatgttctccaggatcttggccaccgagaggccggccgtgccgaccagccatgccggcgggaacagcgagaacagcagcaccgcccggctgccgatctccaggctgcgctgcaccttgatcacccggcggatgtgcgcggcgtcgctttccccccgggcggcgagcacctcgtcccggatggcgtccagttcccggccgatcgcctcgatgtcctcggcggtcaggtgggcgatcgggttgtcttcccggcgttgcagcgtcgtcacaggttcctcgtcttcctcaggcggctttgcttcaaggggggtctcgcagggaggtcaggcgtccaggtggcacgggccggcggcggccgagatgcacgtctggatcaggacgttgtcgccctcgacggcggtggtgatctgtccgtcgcgcatgtcgcgcacgatgccctcgcgcatcggcagcacgcagctgtagcagatgcccatccggcagccggacggcatgagctgcccggacgcctcaccggcatcgaggatggagacgccggccggggcctcgaccaccgcaccggaacgctcgaaggtgaccgtgccgccgtcgccggcgaccagcacggtggggcggaaccgctcgacgtgcaaccgctcgccggcgccggcctcggcccagtggtcggccatcgcgtccagcatctcgcccggcccgcaggcccaggtctcccgttcgaacaggtcggggaccagggcgtccaggtcggccggcttgatccggccgtcggtcgcggtgtgccgctcgatcagcgtgatcgaaccggccgcggccagcgcgcgcagctcggcaccgaacaccacgtccggcccggtgcgcgccgagtgcaccacgaccgcgtcgctgagctcgtgcaccaggctgcgcaggatgcccatcaccggggtgatgccgctgccggcggtcacgaacaggctcttcgccggccgctggcgcggcacgacgaagtcgccggccggcaggtccaggttgacgatcatgccgcggcgggcatttttcatcaggtacgcggagaccacgccgtcgcgtacgccgttgatcgtgacgctgattctcccggaggggtgtcccgccgcgctgctgaccgaatatgcccgccacagccggatgccgtcgacgtcgacgccgagccgcacgtactgtcccggctcgtgcgggcgccagccgcggccgggccgcaggtcgagggtcaccgcgttcggggtctcgcggcggaccgcctcgatccggccgcgcaggacgttcggattgcgcaggggggcgatcacgtcgaggtagtcggtcggcaccaccggggtggtgatcaactcgacgacacgccaggcgccgttgcgcaatgtctgtgtaacagccacctgaccaagcctggcggcccggacgggcgaaagcatgaccggcggaagtgaatcggaggcaccataattgttcgccgggaacaagagcaggaccttaaaccggaggagtctggtgatcgaaccgttacgtgacgtccggtcgtaccgtctgcccgcggcggtcgtcgatccgctgcggcgcggcctggcggaggtcgccgtgcagacgatcgccgcgatcaccatggaggtgccggcctacgccgaggcgttcgccggcgagctcggccacaagatcgagcgggccgtgcaggccgccctcggcaccttcctcaacctggtctcccggcccggcaccgaccccggcaccccgctcgcggcggcgctggaggcggcgtacgccctggggcggggtgaagcccgctccggccgcagcctggacgcgctgctctcggcctaccgggtcggcgctcgcgtcgcctggcgcgaactggccgccatcagcgtacgctccgggcagccggccggcaccatcgccgacttcgccgaactggtcttcgcgtacatcgacgagctctccgcggccagcgtcgccgggcacgccgacgaactggccgcctccggccggatccggctgcggcacctgcaactgctcgcccaggccctggtcgccggcgagccgtcgcacgtgctgcaggccgccgccgaacgcgccgagtggaccccgccgcagaccctcaccgcggtgctgctgcccgagcgctcctcacgatcgctgatcgatctgctggatccgcgtacgctgcccctggccggcgccctgcccgacctgcccgggacggcggtgctgctggtccccgacccgcagggcgcctcccggccgcatctgatccggctgctcaccgggcacaacgcggtgctcggcccggcccggccgtggcagcgcgcgcagtgctcggtcgaacgggcggtccgcgtccaccagctgcacaccccgatcggcggcgcggtggtcgacactgaggaacacctcgccgagctggtcgtctcggccgaccgcggggcgctggccgacctgcgtgaccgggcgctggccccgctcgccggggagcgcggggcggccgcggccaagctggtcgagacgctgcgcagctggctgctgcaccacgggcggcgcgaggacgtggccaccgagctgttcgtgcacccgcagacggtgcggtaccggatggcgcggctgcgggaactgtacggggagaagctcaaggatccgcagtgggtgctggcgctgaccatcgccctggccgtcccgccggtcgcggaggcgtaggcatataccaaagtcgcgggccatctactttcggcaactggagggtggcccccacccgccctagcgtcgggggcatgaccaggacgagcgccaccctcgactactcgccgaccgaccgggtgctgatcgccgccggcccggcggtgctcgggctgctgctcgccggggtgctgccgatcggcgcccgatgggcgctcgggctgcacctgccgctgccgttgcggccggccgtcacggtcgtcgcccgggtcgacgcgccctgggagttcgccgtgcaggccgtgctgctggccggcgccgggctgatcgcctccgcggccctgcacgagcgactgatcccgatcagcgtgtcgcccgaccggctgcgcctcggcgggaccgagctggcccgcgccgggatcgcggcgatctatccggacagggacactctgatcgtgctcgaccacgaatcccgcccggcggcccgcggtatcccgcgcgcccggcgcgggacgctcgccgccacgctccgggagttcggatacccctggcgcgacaccgacccgtacgcggatgtctaccggccctggacggccggcgccgacgggctgcccccggccgtcgaggcggtgctcgccgcccgggcggtggccctggaacggaaagccggccgggagaccgcggcactgcgcgacagcctggcgcggctcggccacgtggtacgcgacgagggcgggcggcagttctggcgaccgctggtgcggtcgtgacccgccgccagcgtctcgccgcggcctccggcgagcgggtcttcgacgcgatcgcgatcgtggtgtccgccgtcggcgcggtggcgatcgcggccgaggccgaggccgccgggcggatcggcggcgacgccacgttctacagcctgctgctggcggtggtcgcgtccggggcgctgtggtggcggcgccggcatccggtggcggtggcggcgctgttcgtgccggtcaccgtggccaccgacttcgccggggtggccgcggtgatcgccctctacacgctgatcacccggcggcgcgggtgggtgatcccgctgctgttcggcctgcacctgctcgccgggaccggatacagcctgctgcggcccgacccgcacctgccggccgcggccgagttcgccgtcacgctggcgttcctgacggcgacggcggcggtcgcggtcgccatgcgggcccgccgggacctggtcgacgtgctgcgcgagcgcgcgctgcgggccgaggaggaggcacggatgcgggccgagcggctgcgggccctcgaacgggaacggatcgcccgggagatgcacgacacgcttgcccaccggatctccatggtcagcctgcacgccggggcactggtgatccggcccgacctgacagccgaggagatcgccaggtcggccgcgacgatccgggagagcgcgcacgcggccctggaggacctgcgggagatcctcgggctgctgcgcgccgggccggacgacctgcgcccgcaacccgatctggcgcaggtgggtgagctggtcgcggaggctagggcggccggggtgccggcccggctggacaacggtctcgccgggggcgttgcggggtcggcactcggccgcacggtgtatcgggtggtgcaggaggggctgaccaatgccgcgaaacacgcgccggggatgccggtgcacgtgaccctggggcgcaccggtgacggcatggtgcacgtcacggtgaccaacccgctggaccggccggccggggtccatccggtcagccgggcgtccggggttcacccggtgacccggccggccggggtccacccggtcagcctgccggctccggacgagggtcgtgagccgccgcccggcgcgggggccgggctgatcgggctcggcgagcgggtcgacctcctcggcggccggttcgagcacggggtgcgtcgggagggcgacgaaaggctcagcttccggatggaggcgtggttaccgtggcggatgtgatccgggtgctgatcgccgacgatgaccggctggtgcggatggggctgtcgctcgtgctcggcgcggaccggcagctggagatcgtcggcgaggcggcggacggggtggaggccgtcgagatgacccggcggctgcggcccgacgtggtcctgatggacatccggatgccccggatggacgggctcgcggcgaccgccgagatccgccggtacggacccgagccggtggtgatcgtgttgaccaccttcgacaccgacgactacctgctcggcgcgctccgcgagggggcgaacgggtttctgctcaaaggcgtcgcgccggaggagatcctggacggggtgcggcgggcgatggccggcgagtcgatcctggcgccctcggtggtgccccggctgatccgccacgcggtgggcgggtccgggcggccccggcgcgaccgtcgcctccagcggctcagcgggcgggagctcgaagtggccgaggcggtcgcgaccggccggtcgaacgccgagatcggggcggaactcaacatgagcgtgccgacggtgaaggcgtacgtgtcccggctgctggagaaactgggctgcgccaaccgcgtgcaggtcgccatcctggtgcacgagtcgcggcggtgacagcatggggtgatggacgacgagccgatgaccgccgaggaggcggagctctcccggatcgagcggttcgggcagctgccgccgcgggtccgggctgaggacctggtggagatggccgacacccggagcgggttcgagacgccggtgacgacgatgaccgaggacgagcggaccctgcggtacggggccggctgaccggttctcgtcgtgtgcaacctggtcttcgccgtgtgcggcggggtttgcttcgtgtgcggccgggccttcgccgtgtgcggccgggccttcgtcgtgtgcggccgggccttcgccgtgtgcggccgggtcttgttgcgggctcggcgggtcggccggggtgatggcacgaaggcgggacgtgccggtgggcggaggttttctagagtccttcccagacggcacgacagcgactgccgtcactggaactcgacggggattctcatcatgcgtacgaagatcgttctgttcgccggcgccgcggctgtcgcactgctcgccggtgggtgcggtgacaaggcgacaccggcggccgccccgggggcgggcgcggtcgcctcggccgcctcgggtgtggccgcggcgcccggtggggccagcgcggcgcccgcggacgctgcgaactccgcgccgggggtcacgccgaccaagaacacgccggtctccacctcccagccgaagccgggcaccaccaaggacggccagccgggtcccgcacccgccggggacccgggtgacggcgggaactggttcgccgcgctcaccccgtgcccgaacaaggggcagcagcacgaggtgcagaaactggtgttcgcggacgtcaccggggacggggtcaaggacgcgctggtggcgagcacctgtcagaccaccaatgcgtactggccgagcaccgtggaggtgttcgacggcaccaccgggaagaagccgaagcggctcggggtgctgctcaaggacgtcgggccgaccgacgagccgtggtatgtgtcgtcgtcggtgtccggaaaggtggtgacggtcaaggcgtacgggctgagcgcccaggcgccgcgggcctgccccgacctgaacctgacctacacctacaagtacggcaacgggacgttcacgcggaccggtcggcaggccgccaaggcctccggctgcctgccgatccagtgatcgcgggtcgcaccggctgacgtcggcacggggcggccctagctagctagagacggggcgcgccctccgccgtgagggggcggagggcgcgcggggagggccgggtcaggccgcgagcaccgagctgacggactcggtgtccaggccgagggccttgccgaccaggtcgttggtgaggacgccgtcgtgcgcgttcaggcccagggccagggcggggtcggcgcgcagggcgtccttccagcccaggtcggccaggcgcagtacgtacgggagggtggcgttggtcagggcgtacgtggaggtgttcgggacggcaccgggcatgttggcgacgcagtagaagaccgagttgtgcacctggtagaccgggtcctggtgggtggtcgggcgcgagtcctcgaagcaaccgccctggtcgatggcgatgtcgaccagcaccgaaccggccttcatccgcttcaccaggtcgttgccgaccagggtgggggccttcgcgccggggaccaggacggcgccgatcaccatgtccgcctcgaggacggactgctcgatcgcgtacgtgctggagaccagcgtccgcacccggccgccgaactgcgcgtcgagctggcgcagccgcgggatgctcaggtccagcacggtcacctcggcgcccaggccgagcgcgatcgtcgcggcgttcgccccggagacgccaccaccgatcacggtgatcttggcgggggcgacgccggggacaccgcccggcaggacgccgcggccgccgctgttgcgcatcaagctgtacgcgccgacctgcggggcgagccggccggccacctccgacatcggggcgagcagcggcagggaaccgtcggcgagctgcaccgtctcgtacgcgatcgcggtggtgccgctgtgcagcagcgccttcgtgccctgcgggtcggcggccaggtgcaggtaggtgaacaggacctgcccggcgcgcaaccggtggtactcctcggcgatcggctccttcaccttgaggatcatgtcggcggcgccccagaccgcgtcggcgtccggcaggatccgcgcgccggcggccacatagtcgtcgtcgctgatcgccgagcccaccccggcgccggcctgcacgacgacctcgtgcccgtggcgcacggcctcgaccacaccggcgggcgtgatcgccacccggtactcgtggttcttgacctctttcggcacaccgatgtgcatggggatgtcctttccctcggcgccgggggcgacgcctgataacgctagagtgaaacgatgtgcagtgaccgggcaagccgagcgaacgagattctgtacactctgtcgactgcgcattttcttcgctgcggcggctcgtggtgaccgacctgccgaaggatgttcgaggcctggatcacatcgacctggagctgctgagcctgctgcgcgccgacggccggatgccgaacaacgcgctggcggagcgggtcgggatcgcgccgtcgacctgtctgacccggatccggagattacgcgagatcggggccattcgcggctttcatgcggatgtcgacccgtcctggatcgggcggccgatccaggcgatgatcgcggtgcggatccgctcggatgcccgggacgggatcgggaagttcgccgagtcgctggccgggatcccggcggtgcgcgacgtgtacttcatctccggcaactatgacttcctgctgcacgtggcggcggccgacgtggacgacctccgctcggtgatcaccgagcggctcagcggcaccaggctgatcgccggcaccgagacctacctgatcttcgagcaccgccgcggcggctgagccggcggcgggcggggcggacagggccgctgcgggcgaggggcaggcgggatgcgcaccgcttcaggtgtccggcgccgggcgtcaggttgttcccggtgggcgccgtcacaccagcggcggcgccaggcggtccgccagcatgtgcgcggcgaacaggtggaagccgatcaccagcggaatggtggccggcacggtcagcgccaggaacaccgccaccagattgatcacggccagcgcgctcgcacaccacggccggttccaggcctgccgggccgcctcccgccaggggagtgcccgcccgagcatggccagcgtcagcgtgcccaccccggtcagccagatcgcggcgaccgtggtcaccgcgaacagcggcgtcccgccgggcacccggccgccgcggacggcggccaggtccagcgcgagcagggcgacggcgggcagcgcggtcatcccgggcaggacgccccggcgataggcggcggtcagcgaccgccagggcgggatgcgcccgtcgcggtaccgggcgcgcaccgccaccgatccggcggccagcgcggccggcgcggtgatcaggggcagtgccagcacggtggccacgacgccgatcatcgccaggtcggtggcgagggccagccgctcccgccagtcgccgcgcaccaccggcgacggttccgccggccaggccgggaccgtcaccggcgacggttccgccggccgggccggggctgccttcggcgacggttccgccggtcgagacggggctgccttcggcgacggttccgccggtcgggacggggctgcctccggcgtaccgccgatgatcggcgagcggccgggagcgacggccggaatctgcagcggcaattcccgatgggacaggtgcgagagcgtcatcctttcagccccgtcgtgttgatgccctccaccagcagtcgctggaaggcgacgaagaacaggaagaccggcgccagcgagagcaccgacatcgcgaacatcggcccgaccgcggattgcccggtggagtcgatgaacagggtgagcgccaccggcgcggtgtatttcgagaggtccgacaggtagaccagctggcggaagaagtcgttccaggtccagatgaacgagaagatcgcggtcgataccagtgcgggccgggacagcggcaggatcacgtgccggaacaccgagtacggggtgcagccgtcgattttcgcggcgtcgtcgagttcgcggggtacgccgcgcatgaactgcaccatgaggaagacgaagaacgcgtcggcggccagcaggtgcggcacgatcagcgggaggtacggccaagggccgccgacccagccgaacgcccggaacatcacgaactgcgggacgatcagcacgtggctgggcagcagcagggtgccgatcatcagggcgaaccagaagccgcgcagccggaatcgcaggcgggcgaaggcgtacgcggccagcaggcaggacgcgcagttggcgagcacggtcagcgcggccaccaggaaactgttcaggaagaagcggccgaacgcgacgtcgaaatgcgtccagccgtccggatagttggccggcgtccactcccgcggccagaccgagaaattgttcagaatctccgagggggccttgaacgagctgcccagcatccacagcagggggtagagcaccagcgcggtgagcacgatcagcagcaccgggcgggtcagtcgggcggtcatctaatcgtctccgtccgaatagtggacccagaaccggccggtgcggaacagcagcgcggtgaccaggccgatggtgagcaggaagacccaggccatcgccgaggcgtagcccatctcgtagttcgcgaagccgcggatgtagagatacagcgtgtacatcagggtcgagtcgaccgggccgccggtgccgttggagagcacgaaggcggaggtgaatccctggaagccgtggatcgtctccagcacgaggttgaagaagatcaccggggacagcatcggcagggtgacgctgacgaacctgcggaccgtgcccgcgccgtccacctcggccgcctcgtacaactcggccggcacctgtttgagcccggccaggaagatcaccatcggggcaccgaactgccacacggccagcaggatcagcgtgccgagcgcggtgtgcgggtcgttgacccaggccttgccctcgatgccgaaccaaccgagcaccgcgttcaccgagccgccccggtcgaacaggctgtgccacaccatcgccagggcgacgctgccgccgagcagtgacggcaggtagaacagcccgcggaacaggccggagccgcggaacggccggttgagcagcagcgccacgccgagcgcggcaccgagcttgagcggggtggcgaggaacgcgaagaccagggtcaccctgaccgcgtgccagtacgccggatcgtggtggaacatccggtcgtagttggcccagccgacccaggtgacttcggagaacgggctcaggatgtcgtagttggtgaagctgaggtacagcgacatcagcatcgggatcgcggtgatcacggcgaacccgagcagccacggggtgaggaagaggtagccggcccggccctcgccccgatgccgggcgggccggtcccgccgctggtcagcggcgggaccggactgcggccgtgggcgggacggccgggtgctgacagccatgtcgctcaccggctaatcgcggcctgggctgcggtgaagaactggtccgcggcctgtgccgggctggcggtgccgaactgcgcggcctcggccgccttgatcagttcggtcttgaccgtggcgtggcccttcggcggcacgctcggcgccggaccgaacttgctgaccagcgagtcctccagggcgatcgacgccttcatggccgggtcggtggtgctggacgcgacctgccggcggatgtccaggttggacggcaggccccggtcggtacccaggatcttgcccgcctccgggtcgttggccaggaagttcagcacgtccaccgcggcgtcccggtgcttgctgccgcggtacaccgagaagtacatcgacgcgcgggcccactgcgcggacgggtcaccggggtaggcgacgacgcccagctcgtccttggtgttcttctggatgtccggcatctggttggcccacacccacgaggtgagcgccttgccggtgacgaccagctgcttggtgatgtcggtggcgttgccctcgtggatcacgtcggcggtcggggtggccttggcgtcccgggcgcccttccacagctcgaaccacttctgcacgtcgtcggaggtgaagccgagctggttgccgttgtagaactgcttgccgttctgccgcagccacacccagaacgccttgtagtcggcgctcgggtccatggtgccgggcaccttggtggcggcgcccgccttctgcgcccaggcgatcagctggtcccaggtcatcccggtggtcggcagctcctgcttggccgcctccagcctggtcttgttgtagaccaggccctgggtgttctcgcccatcgacatgccggccagcttgttgtcgaccacaccgtacttccacaggctctccgggaacttcgaaaggtccaacttcccggagtccttgtacgaggtgaggtcgagcgtcacgttgcgcgtcgcgtactcggcgaggtagttgtcgtcgatctggaagatgtccggcgcaccgtcgccggcggtgagcgtcgccagcttgtcgaagtacccctggttggcctgccaggtggtcttgaacgtgatgtccggatgcctactggtgtacaggtcgagcgcctgctgggtgagtttggcgcggccctcgccgccccaccagaagaaggtcagctgggtcttgccggcactgctggagtcgtcgccgccgcaaccggccagggccagcggcaggacgagcacggcggccatcagggcacgtgacagtcgaagtgcggacatggggatgggtcactccttggcgtatgcggcgacctcggtgcgggtcgcgccggccggggcgtacggcccgggcccggtggagttgcggatgaccagatcggtccggagcgtgacctgcccggtggcgccgtcgtcgccctgttgaagcagcatgtcgacggcggcgcgcccggcggccgcggtcgggttcgccacggtggtgagggtgggacggatcagtgcactggtcacgatgtcgtcgaagccgacgacgctgatccgttccggcacggcgatcccgcggtcctgcaacgactggagcaggccgatggccatcaggtcgttgtaggcgagcaccgcggtggcgccggtggcgagcaccggctcggcggcgtccgcgccggccgtggtgaccggcgcgtgcgggccgagaacggtgaggtccgctccgccggcccgggctgcggccccggcggctttgcggatctcccggttggtccacgacccgcgcggaccggcgaggtagaccaggtggcggtggcccaggtcgacgagatggcggacggccgagcgtgcgcccgcgccgacgtccatcaccaccgccgggagcccgtcgatcaggcggttcacgacgaccaggggcacctcgcggcgcgactcgacgatctggtcgtcgctcatccggggactgcacagcaggatcccgtcgacctgcttggccagagcccggacgaggtcggtctcgacgaccgggtcctcgtcggtgtcggcgacgaagacgtggtagtcgcgccgccgggcgtgggtctcggccgccttgatcatgggtgggaagaacgggttggcgatgtcggccacgatcaggccgatgttgtgggtccgcccggtgatgagtgcccgggcggcccggttcgggcggtagcccaactcctccgcggtggccagcacccgggtgcgcgtctcggggttgaccaggtgcggcgccgagaaggtgcgcgacaccgtggagatgtgcacaccggacgccttcgcgacgtcccggatggtcacggccacgatgccacctccccgaagtgtgatccggctctctctggtggagccattaatgcaaacggttgcgtacgtgtcaacgcccttcgatgcaggattgcgctttcccgcccttgcaaaggcctcgtaagtagacataagactccatgtattgactcgcatcgtcatctgatcgctaatctgatgcaaacgtttgcggagggagatgtcgtgattcgctacgccctcgtgggagccggtgcccgagccgggatgttcatccgggcgctcaccggcgaccacgccgacgtcgcgcgactggtcgccctggccgacaccaacccggcccggccgcaggtctaccgcaggcggcacgacctcgacgtaccggtctatccggccaccgggttcaccgagatgctgcagcgggagcgggtcgacgtcgtgctggtcaccaccgtcgaccggtaccacgagcggtatctggtggcggccatggaggccggctgcgacgcgatcaccgagaagccgatgaccgtcgacgccgcgtcctgccggcggatcctggagacctcccggcgcaccggccggagcgtccgggtcaccttcaactaccgctacaacccgctgcacgaagcggtgaaacgggcgctgccggagatcggcgagatcggctcggtgcacttcgaatggctgctcgacgtacggcacggcgccgactacttccgccgctggcaccgcgagaagcagaactccggcggactgctcgtgcacaaggccgggcaccacttcgacctggtcaactggtggctcgacgacgcgcccgagcaggtgttcgcggccggccggctgttcttctacggcgaggcgggccggcggcacgggtacgcccgcgactacgaccgggcgcacggcgccgcggccgccgagggcgacccgttcgccctgcggatggccgacgagccggccatgcgcgagctgtacctcgacgccgaacggcacgacggctacctgcgtgaccgcaacgtcttcgcgcccggcgtgaccatcgaggacgacatggcggtgctggtccgctacgccggcggcgcgtcgatgagctaccacctcaccgcgtacgccccctgggagggctaccgggtgatggtcaacggcagccgcggccgcctcgaactcgaggtcgtcgagaccgaccacgtcgccccggccgccgccgccggcgtcaagggtgagcccggcgcggtctccaccgccgagcggggctggcggcgcctgctgctgcgcccgttctgggccccgccgcgtgagatcaccgtggacgggtactcgcggcagggacacggcggagccgacctgcggatgctcgccgacctcatccggccggacgcgccgcccgacccgctcggccgcggcgccaccgcggtggacggcgcccgtgccctgctcaccggcttggccgccaacgaaagcctggcaaccggacaggccgtccgcgtgtcagacctcctagatcttgaggagatcaggtgactctgttccccgccgaggcgacccagcgcgggatcgcccgtgagctctacgcccacgcccgcgacctcccgctgatcagcccgcacggccacgtcgacccggcgctgctggccgaggacgagccgttcggcgacccggcccggctgttcgtggtgcccgaccactacgtcacccggatgctggccagccagggcatcccgccggcccggctcggcgtgccgagcatcgacggcagcccggtggagaccgacggtcgggccgtctggcggctgctcgccgagaactggcacctgttccgcggcaccccgtcccggctgtggaccgagaaggtcttcgccgaggtgttcgggatcgggaaacgcttctcggcggcgaccgcggacgagatctacgaccagctgtccgcccggctggccgagcccgactaccggccccgcgcgctgttcacccggttcaacatcgaggtgctggccaccaccgagagcccgatcgacgacctcggcgtgcacgccaaactggccgccgacgggtggggcggaccgggtggccgggtgatcaccacgttccggccggacaacctggtcgacatggagtgggacggctgggccgaccgcgtcgccgcgctcggtgcgctcaccggtcaggacgtgggcacgtaccccggcttcctgaccgcgctgcgcgcccgccgcgaactgttcgtggcggccggtgccacctgctccgaccacgggcatccgaccgccgccaccctcgacctggacgacgccgaggcggccgtgctctaccgcaaggggctgggcggggcggccgacgcgcgcgacgccgaggcgttccgcgcgcacatgctggtcgagttcgcccggatgtcgatcgacgacggcctggtgatgcagctgcaccccgggtcggtgcgcaaccacaatcaagcgttgtacgcgcggcacggccgcgacgtgggcggcgacatcccgtcggccaccgagtacgtccgcgccctgcgcccgctgctcgaccggtacggtcacgacccgcgcctgcggatcgtgctgtacaccctggacgagaccgcgttcacccgcgagctcgcgccgctggccggcggctacgccgcgctctacctcggcgcgccgtggtggttcctggacagtccggagggtctgcgccggttccgggaggcggtgaccgagacggccggcttctacaacaccgccggcttcgtcgacgacacccgcgcgttctgctcgatcccggcccggcacgacgtggcccgccgggtcgacgccggcttcctggcccggctggtcgccgagggccggctgccgctcgacgaggccgccgagaccatcgccgatttggcctaccacctgcccaagcgggtctaccggctggaccgggcggcatgaccgtgaccaccactctcggccgcgccgcgctgcccgggctggctccgcaggcccgccccctggtcacgccgggcgaggtgcggcccggcatcctgcacctcgggctcggcgcgttccaccgcgcgcaccaggcgatctacaccgaggccgcggtcgcggcggccggcggcgactgggggatcgtcggcgtcgcgccgcgctcccgcgacgtgctcgacaagctgcgcgctcaggaccggctgtacagcgtgctcaccgtcggtggcgacggcggcgaccgggcccgcgcggtcggcatcctctccgggctgggccacgccgccggtgatccctacggggtgctggccgcgatcgccgaccccgggatccggatcgtgtcgatgaccgtgaccgagaaggcgtaccggctcggaccggacgggaaactgcttctcgacgacgacctgcgggcccagctgaccgggcaggcgccgccggtgagcgtgcccgccctgctggcccgggccctgctcagccgctccgcgccgctgaccgtgctgtgctgtgacaacctgcagggcaacgggccgcggatccgcgggatggtggagcaggccctcgaggtcgccggggccgggctgccggacggggtcgacttcccggccaccatggtggaccggatcgtgcccgccaccagcgccggccacctgcggcgggcggccgtggcactgggcgcggcggacgccgcgccggtcgtcgccgagccgttccaccagtgggtgatcgaggaccgtttcccgggcgggcggcccgactgggcggcggccggggcgatcatgaccggcaacgtggcgccgtgggagacgctcaagctgcgggcgctgaactcggtgcactccgcctgcgcgtacctcggtgcgctggccggacaagagatgatctccgacgcgctggcgttgcccgggatgggcgggctgctgcgccgcttcctggccgaggacatcgcgccgacgttcacgccaccgcccggcatccgggtcgccgactacggcgagacggtgctggaccgcttcgcgaaccgggagctcgggcatcgcacccaccaggtggcgatggacggcacccagaagctgccgcaccggttgctcgggacgctggccgaccggcgccgggccggtgccgtcccggtctggggcgcgctggtgctggccgggtggatgcggttcgcccgggggtacgccgacgacgggaccgcgctgccgctcgacgacccgctggccgggcggatccgggccgtcgtgagtgccgcgccggacaccccggccgggctggtggacgcgctgctcggggtgaccgaggtgttcccggcggcgctggccttcgacaccgctctgcgcgccgagctgatccggtggtccggggagctggcccggcacggggcggcggcgacgatcgcggcggccgggcgatgaccgggcggtcccgccgggtccggtcgccgcgcgacgcgctgcgcctggacggtcgagcatgacggcccgggtggcgctgcgcctggacggtggagcatgaccgcccgggtggcgctgatcggggccggtgggcacgggctgtcgcatcggcgcaagcttcgcgagctggccgggctcggcgagctggagatcgctgcactgtgcgaccggaacccggtcgacccggaacccgcagtgcccgtcttcaccgatcacggcgcgatgctcgcggcggtccggccggacgcggtgatcatctgcacgccaccgcacacccacctgccgatcgccctcgactgcctggccgcaggagtggatctgctgctggagaagccgccggtgacctcgctgagagagcacgagacgctggtgacagcggtccgggagagcgggcggcgctgccaggtcgggttccaggcgctcgggtcagcggcgctcacccggttccgtgagctgaccgcggccagcgccggtgacctgtccgcggcgggcgcctggtggcggccggacacctactatcggcgtgctccgtgggccgggcggcaggcggcgttcgacggggcgctggtgaatccgttcgcgcacgcgctgatgcaggcgctggcggtggcggacgggttcgagccggttctgctggagctggaacggtatcgcacccgggatatccagaccgatgactgtacgttcctgcgtctgaccgatggggacggccggcggatcgtggcggcggtgaccctggcgtccccggtgttcgtcgcgggggagatccggctcggggacatcgtgctcgagtatccgaccgatcgcgtgcttctcggcaggactcatcatgagctgtgggggcggaccgggctgctggagaacctgctgtccggcgagccgctggtggcgccgctggagcggaccagggcgttcaccgccgtggccgaggcgatcgtggccgcgccgctgccggcgaccgttccggcgggcgagctgcgcccgcacccggacggcgacggcaacgtgcttcccggcgccgatgaactcgtccggcaggtcgccgccaccggcctcctgccgtccgagaccgacgtctcctgggcggccccgccgcaccgggtgaccctcgaaacgcggaaaggaacgaccgatgcgcaaactgagcgtcgctgagctcgaagcccatcaccgcggggcgaccttcaccagtgtgctgcccggccacgtcgtacaaaaaggcggtttccgggtttatgccgagccgaacttccgcacgcacgacgagccgggccggcacgtgcacaccgtgccggagatcttcgtgatcgtccagggcagtggcgtgatggaggtcgacggcgccgaagccggtgagttccgggccggcgacgcggtgatcttcgagccgggggaggaccaccacctgatcagtcgcggacccgatccgctggtcttcgtctggatgcacctggaacccgtctcctgaaccgccgcacctcgctcccttccgtgaccccgcgcggtcgtccgccgccggtttcctcgctctttgtgacgatcctggagtgatcatgtcccgaagatccgccctcgcggcgacgatcggcctcgtcctggccggagtcgccaccgtccctgccgccgcttccgcttccgccgcgacgatccccggatcagctgtcccaggatctgctgtaccgggcgttgctgtaccggctgccgcccggcaggttctgccggtgaacgacggctgggccaacggtgccaccggcggctcggcggccgccgccgaccacgttcatgtggtccgcacccgcgacgaactcgccgccgccctcgccccggccgacaccgctccccggatcgtgctgatcaccggcacgctgcgtccggacggcgactgcgcggcctacaccgacccggcctactcgctcgacggttacctgggcgcctacgaccccgcggtctggggccggaccagcaagccgagcggcccgctggaggaggcccgcgcccgctccgccaagaaccaggccgcggacgtccagctcaaggtcccgtccaacaccaccattctgggcctggcgaacgcccgcctggtcgggctcaacctgctgatctcggccgccgacaacgtcatcgtccgcaacctgcgcctcgaggacgccgccgactgcttcccgcagtgggatccgaccgacggcgccaccggcaactggaactccgcgtacgacctgatcaccctggtcggcggcacccacgtctgggccgaccacaacacgttcagcgacggcgacgacgtggacgcgaaccagcccctgtacttcggccgcccgtaccaggtgcacgacggcgcgctcgacgtgatcaaggcgtccgacctggtcaccatctcgtacaacgtgttccaggagcacgacaagacgatgctgatcggctccaccaacacggtcggcgccgacgtcggcaagctccgcgtcacgctgcaccacaacaggttcgccaacatcggccagcgcgccccgcgtgtccgattcggacaagtcgacgtctacgacaactactactacgccaccgacgaggacttctaccagtactcctggggtgccggcgtctactcggccatctacgccgagaacaacttcctgctacgcagcgccgacatcccgctggacgccgtcgtccacaactggggtggcaccgcgatgaccgagaagggcaccctcacccggatcggcaccggcaaggtcaccccggtcagtctgctcgccgagtacaacgccacccacgaccccgacctcggcaccgacgccggctggacccccacgctgcggcccggcccgctcacccccaccgcccaggtcccggccgtcgtcaccgcccagtccggcgccggcaggatcaacctcagctgaccgattgcggcatacgccgtgagcacccgagccgcggccgacgccccgcgccgtccaccggcgccggcgcccgctgtcggctcgggtgcctgcctcgcgggtccacggccatcgcgtgccggcccggccgggaaggccgtccgcggtcgccgcggaaacgcgtcgccggtgtgcggctgatccggttcaataccggtggtgatcaccttgcgcgccgtcgtcgagctgggctccgaccgttggctggagctggacggtcgatgcggcgccgagcaggccgcgctgttcgtcggcgcgctggcgggagcggacgccgacctgcccgcggccgagcggatcgccgccctgctcgcggccgagatgctgatcgtcgccggtggcctcgctctcgatgacaccgtgtccggggtgtcgatccgcccgggttgctgcgccggcctggaggactggcgcgactgggcgtcgatcgccgcggggcagccggtgtggctggggcactcgccggagccccggatcgaggtggacggtgaccggcgccgggtgtggcaggacgtgacccccggcagcccgcacgtcgacgtgaccggagctgagctgttccggctgctggcgggcgtgcagcgggatctggtcggctttctcggagtgctccgtgcctggggccggtcgttcggtcgcggtgacctcctggcggcgcggatcgaccgggacttcgcgatcaccgcgcccctgccggatgccgggtgggtcgatcaggccatctcgtaggtgcggcggacgtgggtgagggtgcccgtcgccaggtccgcgtcggtgatccagaaggtgacgctgacgacctcgccccagacggtgccggcttccggccgcagttgcagcagcgggcggtggtccggcggctgggggcccaggtggtccgggtggccgagcaggcggtggcggggcaccggaaggtgcggccgcaggtcctcggcgaggtggagcagctcgtcgaggtccacgtccagatggtcggccaggtcttccggggcgggcagggtggcctgcggggccggggtgagcggggtgggttcgatggtgcgccggatccgggggaggggggccaccgggtcggccgggacgtgcaggacgcggcaggcggtgtcgccgtgcggggaccacccggcggtgaagtcctcgtcgtggaagaagagcaggctgccgtcgtcggggaacggccaggccgggccgaggagggtggcggcctcgtcgccgtcgagggcggccagcagcagcatcggggtgccccggtgcatcggccagtcgaaggcggccagccgtggctcgccgccgaacgcggaccagccctcgtccgacggctcgtagccgatcgacgggcggctcagcgccagcagagcgttcgcccgcggttcggcgaaacgggtgcggaccagcgctcggacctcggcggggagattcatgatggccgagtgtcgcacattccgctcggcgaccttttacgaacgtaccggaaagcttgttgttgatttgtcggcggtgcatcgaataagtcgcaccttaaaggcgccgcgggcggaaccttaagttttcctttagttcgatccgcgctgggagcgttcccgtatggatgggggagaacgcgatcgagcaggaaggcaacacagatgaagcggtaccggagtaacgctgcaggctccaacgcccgccgctggcgggtcgccggcatcgcgggcgtcgcggtggtcctcgccggcgtcgggctcggcgtggcgaacgcggcgacctcggaggccgtgccgaccgtcaactgcccgcaggtggccccccggctgccggccgtaccggcggccgccaaagccgaggtggagcggaacctcgccctgctcaacacccagatccaggaggcgaacaagcgcctggcgaccagcgtgggacagggcggcccgaacttcatccagaacgcgatcctgggcccgctgaaggacaagcgggcgtccacgatcgaccggatcgccatctccatcggtcgtcgagccgccaagccgaacctgccggtcaaccagctcgcgacgtgtgcgctcaacaagaacggtggcggaaacgcggccccggaaccgaccacggtggccgccgacaacggtgccgcagccggcaacaatggtgcggcggccggtgtgccgaccgttaactgcccgaccgtcggcgacaaactcccggccgttccggcgtccgccaaggccgagatcgaacgcaatctggcgctgctgaacacgcagatccaggaggcgaacaagcggctcgcgagcaccgtcggccaggggggcaagaacttcattcagaacgccattctcggcccgctgaaggacaagcgattcgccaccatcaatcggatggagaccgcgatcggccgggccgcggcgaagcccgacctgaacgccgagggcctgtccggctgcaccctgaaccagaatggcggcggcaacccggcgcccgagcagaccgccgtgcaggcccaggacccggccgtggcggccgcgaacgcgccgaccgtcaactgcccggacgtcaagatcggcgtggcgatcccggcctcggcgcaggccgagatcgaccgcaacctggccctgctgcagacccagatccaggaggcgaacaagcggctggccagcaccatcggtcagggtggcccgaacttcatccagaacgcgatcctcggcccgctgaaggacaagcgcttctcgacgatcaaccggatggagaccgcgatcggtcgtcaggcggccaagccgaacctgaacgccgagggcctgtccacctgctcgctcaacaagtgacgaagcactgagtgaaggggccctccggggccccttctccgtctatgctccggcggattgcaccaccggaggagacgcacgtgccaccatccctgccccggccggtccgggtcggttcactgtcgtacgcggtcgcggcggtcgccgccgcgctcgtcggcgtcatggcggtcgcctgctggtggcgggtcggcgcgacggcggacagcttcctggcgctgcccctgccgccccgggatgtggccgccgtcccggcgaaggccgcgtccctgcgcctggcactcggcggcagcgcggtggccgcgatcctgatcgccggggccgccggactgctcgcggcgggaatccagcgaccggcggtcgcctggatccgcaccgccgggctgtgggtgagcttcctgggcggggcggcgctgatcgccggcgtgctgctggtgccggtggatcgcagcgagggcaccacggtggtcatcgacctggccgcggtggcccacaccgacctcgggtccggcccgctcccgctggcggactggtatcccacggtgttcgtcccgctgggctggctcgccttcgccgcgctggtcgccgcgggattccagctgtcacggacgtcgatggccgactactcccgcccggccagccacctggaggacgagcggtggaccagtttcgtccagcgacagcaggagcggcagcagctgcccggcgagtgatccggggcagcgccggcggtcaggcggtgagctcgcggtaggcccgcaggaccgcggacgtgtggtcggccagatccagggcctcgtcgtcgggcggggcgggcgcggcgggggagagcaggtagtcggaggcgcgcagggcggcgcgggccgcggcggacgcctgctcatgacgtacgaaagcgtcggtttcagcggccaggcgggtcaggtgggtgagctgatcgcgggcctggacgcccagatggcgcaggcgcagccgcgcctgcgcggcccggtcggccagctcggcgcgcagcggggtgtccggcgggaccgccggatcgacgtcggtcagccggtcgcgggtgcggcggacgcggtcccgctcgatcagcaggccggacaggtcccagagggtgcgggccaggcgcgggctggggtcggccagaccgacgtgtccgctgaggatcggccagcgtcgcagggtgcgcacggcggcctcgatcgagcggtgcagggcggcacggtcgccctgatggacgacgaaacggtactccccgggggagcggccgagcatccgccagctcgccgagcggggtggctcgaacgcgagacgtaactgtccgtagacgcccgggcgggggcgcagcagcaccagcgaacccatctcgaggtggtcgcagggcaccgtggcggccggcgcgcgcagtgcgacgcacgtctcacgcacgccctcggccaggaacacccgcacccggccgattctgcccggacggtgcgccgatgcccagcccgccggcgatggatggtcatccggcggccctcgcgatagcgtgcgttcttcgcgtgccacccggatacgtgatagaaatccgcgccagcgagaatgccccggacgacgaggaggaacggcggtgccaggcagcgcacgcacgatcaccggcagtagcgccgcacctgacgttcatctcccggcatcgatgaagggcctgcccgcatgaagcactagctagctagaatggatctgctggcgcccggggcggtgcggatcgcgccggtgacgccggtggcgtcgacggccccggtggcgccggtggtcgccgaggtggcgccggtgtcggcagctttggtctcaccggggccggtccggccggtgcagccggtgcagttcacgccacccgcgccggttgcggcaccggccgccgctccggttgccgctgcgccggttgccgcgtcgctcgctgcgccggtcgccggtccggtcgccgctccggtcgttgcggaagggccggtgcggcccacggtggcgcagatcgcggcgctggtcaccgcgacgtcggaggcgccggtggccggatcgctcgggcagcggctcgcggcggcggtgacgcccgaggagatgctggggatgccggcacccgcaccggaggcgacggccgacgtgccggcgccgcggcggccggcggagcagacggcggtgcccggtgcggtgccggcggtgccggggccgatctccgcgccgcggccgttcctggccacgagcccggtccaggcgaccaacggtggagccaacgggacgaatggtgccggcaacggcaacggcaacggcaacggcaccggcagcggcagcggcagcgccgcgcagggggccgccccgcagacgccggcctgggcggccaccccgaccggagcccagcgcgccgtcaacatcgtcggctcgccctggtggcggctcgccgtggagcgcatggcccgcatcgtgcgtagcgagatcacccccgacaatctgtcggagatgacctattcccggatggcggagctcgtcaaatcgatcgcgccgcgggtctccggtctcggcgagggcgtggtgaagtcgttcgtcaacgactacgtccgcgagatgaacggtgaaccgggcgaggccgcctacccgtggcgggacctgctgcccgacccggtgaccctgccggtcggctccgagctgtggatgcaggagatcgaggatctgcgcaccgctctggtcgaggagctggagagcagcgacgagacggacccgcgtgagctggcgatgatgctggcgccgagcgttccacggctcgacgacgagacgatccgcgcgttcgtcagcgactacgtcgccgcgctcggcggccagccggtcggcgtcgaccagccatgggagcacctgttgccccgcccgcagggtggtcgtggtccgagtgacgaggagatcgtcgagcagttcggcgggctgctgcacgagcacctgcgcaccaacggcaggctctcccgctaccgggtgaccgcggtgaccggtgtcaagggtgcccgcgccgaccggatcaaggggatcatcgaggaccaggccgcggagtcggccccggcgtgatccgggctacggcccggaccgccccggggccccgggcccgcacggttgccgctgccgaccgggtgcgcggagtgtccccgggccgggatcgctgcagtcggggtcgggctcacgtcagtcggggccgggctagcttcagtcggcgccgggctcgcttcccgtcgaagccgggccggcttcagtggagcagccaggtgatcaggtcgccgccgtagggagaggcggcgaccaggaccaggaccagccagctcgcggtgagcgcggccagccacccggcccgtcgccgctcgtcgcgccgccagctgtgcaccagcgtcaccaccccgaagctgatcatggcgatgcccagcggatagacgaaccaggccaccagccggcagaccccgaggaccccgaccagcggattgcccgccccgggcagcgaatcctcgggatcgccgagccgatccagcccgggatgcagcagtgccccggcgtcgcccacccgcacggcggccaggatcaggatcccgaaactgccgatcaggtacgccgtgagcagcgtgagctgcacccacaccaccgccctgccggctgccggggccggccgggtccgatcgacgtcagtcacccgcgcaatctacccgcccgggctcaggccggggcggcgcagctctcccgccagatcagcgtggccgcggccggctcgctgaccccggcggtgtcgtcggccagggccagggccatcgcccgctcgcccatcccgaccagcggcagccgcaccgtggtcagcgccggtgtcacgtcccgcgcgatcggcatgtcgtcgaacccggcgaccgacacccgggccggcaccgcgatgccgtgctcgcgcagggtggccagcgtgcccaccgccatcgagtcgttgagcgcgacgatcgcggtcaggtccggtgcggcgccgaggagccggcccgcggcttccgccccgccgtcccgggtgaagtcggcgtagacgatccgctccggcggcagggccgtcccggcctcggcgagggcccggcggatcccggacagccggtcggtggtggtggtcagcgaccggggcccggcgatcaccccgatccggcggtgccccagggtgagcagccggcagcccaactcgtacgccccggattcgttggcgggcaacacggcgctgccgaccagctcgtgccggccgatcaccgcgacccggccgccgccctgctggtacgcgttcagctcgccgttgagccgggcggtgaacgcgtcgtcgtggtatcccgagccggccaggatcagcgcgtgcacctgctgggcccgcagcagcgccacgtaggccagctcgcgctccggctcccggtagctgttgcagatcaccaggagccggtcgtgggccgcggcctgccgctgcaggccccgggtgatctcggcgaagtacgggtcggagacgtcgtgcacgatcaccccgaccgcggacttgcgcgggcgggccacgctctgcgcgtgcgcgttgggcacgtagtgcagctcggcgaccgcggccaggacccgctcgcgcagctcgggcgcgaccttcttggcgctgtcgttgatcacgcgggacaccgtggcgggggagaccccggccagccgggccacatctgccagggtgaccgccatcggaccagcatagggaagaccgcgccggcccggcggcccgccccgccggtgcggtcagcggcccagcagtgtcagggtgtccacgacccggttggcgaagccccactcgttgtcgtaccaggcgaccaccttgaccagccggccgttcgccgcggtcagcagcgagtcgaagagggacgacgccgggttgccggtgatgtcggtggagaccagcgggtcggccgagtatgcgaggaccccgcgcagtgggccggacgcggccgcctcgaaggcactgttgatctcggtggcggtgaccggccgctcgaccaccgcgttgagctcgaccagcgagccgaccggcaccggcacccgcaccgagtatccggtgagccggccggccagccggggcagcaccaggccgatcgcggtggccgcaccggtcgtggtgggcgcgatgttcagcgccgccgcccgggcccggcgcaggtcgcggtgcgggccgtcctgcaggttctgctcctgggtgtaggcgtggatggtggtcatcgacccggtctcgatgccggccaggtcgtcgagcaccgaggcgatcggggccagcccgttggtggtacacgacgcgttggagaccacgtcgtgcgcggccgggtcgtagtcgccgtggttcaggccgtaggcgacggtcagatcggcgcccggggacggggcgctgaccaggaccttgcgcgcgccggcggccaggtgcgcgcgggcgtcggcggccgcggtgaatctgccggtcgactccagcgcgacgtcgacgcccaggtccttccagggcagttcggccgggttgcggacggcggtcacctcgacccggtggccgtcgatgagcaggtggtcctcgtgtgcctcgacggtacccgggtagcggcccagcgagctgtcgtagcgcagcaggtgggccagggtgccggagccggtcaggtcgttgatcgcgacgatctccacgtcgctgttcgcggcggctcggaagacattgcggccgatccgcccgaatccgttgattcccacgcgagttgtcatgccgtcagcctgccgccgtgccgagccggtcggcagggggccgcgcgtcaccttgcgcaagctttccgccagcgaagttccggcggtactcactcggcgaggtgctcaggatccgctggaagtgcatccgcaggttggcgccggtgccgacgccgacccgggcggcgatctgctcgatccccaggtcggtgcgctccagcatctcgcgggccaggtcgacccgggcgcgcagcacccactgcatcggggtgtacccggtgtcctcgacgaaccgccggccgaaggtgcgctccgagacgccggcgtgccgggccaggccggtcacggtgagcggctcacccaggtgcgccagcgcccactcgcgggtggccgcgaacacgtcgccgagcggctccgggatgctgcgcggcacgtactgcgactggccgccgctgcggtacggcgccgcgaccagcacccgggcgatcgcgttcgaggcctgcacgccatggtcgcggcggaccaggtgcaggcacacgtcgatgccggcggccaccccggccgacgtgaggatctgaccctcgtcgacgaacagcaccctgccgtcgacggtcaccttcgggtactcccgggccagtgtcggcgccatcagccagtgcgtggtcgcccgcagcccgtccagcagaccggccgcggccagcgcgaacgcgccggtgcagatggagaccatccgggcgccgcggaacgccgcggtgcgcagcgcggcgagcacccgcgggtcgatcggaccggccgggttgaggaagccgggcacgatgacggtgtccgcgtcgtccagcgcctccagccccgcgtcgacgaagaaaccgagcccgtcgcggccgcgcaccggcccggcctcgaccgcgcacggcaccgcccggtagtccagcccgtgccgcggcgcgaagacctgcgccgggatgcccacgtccagcggtgcggccccgggcatgagaaacatcgccaccttgtgtccccgcatgtccccactgtgccggtcacggcgtaccccgggaagtggccgtgcggaccatgaccgcaaggattccgccagcacgggaggcggagcgctcccgtggcagggaatcggaccactagaatcactggtccggcgccgaagcggttgtactttgtctcaagccggtgacgtggagaggacggctggcgatgagggaccacagcaaccgctcggccgggcggccgaccctggaggaggtcgccgtccgggccggcgtcggccgggggacggtgtcccgggtggtgaacggctccgcccaggtcagtccgaaagcccgcaaagcggtgcaggacgcgatcgacgagatgggctacgtgccgaaccgggccgcgcgcgcgctggtcacccagcgcaccgattcgatcgccctggtcgtgttcgagtccggcgagcggttcttcgccgagccgttcttcggccggatcgtccagtcggtgtcgtccgtgctggtcgcccggaacctgcagatggtcctgatgatcgcgcaggccccggaggagcggcgccagctggagggctacctgacccgccagcatgtggacggcgcgctgctgctgtcgctgcacggtgacgacccgctgccggccgtcctggaggagcgcggcgtgcccaccgtgcgggtcggccgcccggtgcacccgggcccggtcacctcggtcgacgcggacaaccgcgggggcgcccgggccgccgtgtcgtacctgcgcgagcagggccgccggtgcatcgccacgatcaccgggccgatggacatggcgccgggcatcgcgcgctaccagggttaccgcgacgtggtcggcgacggcccggccgcggccggcgacttcggcgagatcagcggcgcgatggcgatggaatggctgctcgccaaccacccgcagctggacgcggtgttcgccgcctcggacatgatggcggccggcgcgctgcgggtgctgcgccgggccggccgccgggtgccggaggacgtggccgtggtcggcttcgacgactcggtcgtggcccggcacaccgacccgccgctgaccagcgtctatcagccggtcgagcagatgggccaggagatggtccggctgctgctggccaagctcgacggcgacgagccggtcgagcacgagacgatcatgccgacccggctgatcctgcgcgggtccgcctgagcctaggccccggcccggcccaggtcggccaggcggtcctgcagcagggcggcctggccggcactcagcccgccctcgccgagccgctggcggaccttcttgcgcaacagatccacctgcccgcggatgtcgggattgtcctgagtggcgagctgccccaggaggttccggaaatcctgcgcgacgtccccgcggatctcgccggtccgctcgccccgatcgaccgcggcctccacccgttgcagcgccacgtccacggtgagcgtcggcgccgccctcttcgccaccgtcggcggagtcgtcgccggccgcggcgaaggtgacgaggcggccgacgtcgccggcacggacggcgcgaccggcgcggccggcggcggctgcgccagatcgtcgcccgactgcgacaccacgtgcaccagcgccaggaaggcgatcgcggtggcacccagcgccgcccccaccgcgatcttgcgaccgcgggtggcccggaccggcggcgggttgagggccggcacccgggccgccccggccggcgggcgccgggcagcggcaccgtcggcgtcttcttgttctccgccggagccagctcggccagcaccttccacgcctcggcggccgacgggcggcactccgggtcgtcgtccagacagcggtggatcagatcggtcagcggggcgggcagcccgcccggcagcggcgtgggcccggtctgccgggccaccgccagctcctcccaggtgtccacactgtacggcggctccccggccaccatctcgaacagcagcacgcccagcccgtacaggtcggtggccggctcggccggcttgccgtccaggcgctccggcgccgcgtacgccggggtgccgaaggtggccccggtgtcgtcgtcgtccggctccccggcggccgcgctgatcccgaagtcgagcagcttcacgccaccgttgcagagcatcacgttgcccggcttgatgtcgcggtgcaccaccccggcggcgtgcgcggcggccagcgctccggcgaccgcggcgcccaccgcggcggcggccggccacgggatcgggccgtcacagagccgggccgccacggtctcgccggccagcagctccatcacgacgaacgggaccaccgagccgtccgggcggaccgcctcccggtagtcgtgcacggccgcgatccccggatgggagagccgcgccgcgagccgcgcctcccgccaggcgaggtgggcggcccggatgtcgccggccggcaacttgaccgcgacggggcggtcgagcagctcgtcggtggcccgccagacctgggccatcccgcccgtttccagcaaggtcacgaggcggtaccgcgataccagaagggcaccgggagccggccagacatcgtgcatgccggaacattcgcccagtgcggacctccgtgtcaaccggcaaccgatccgcacccggccgcgcaccggaccggaaccgggacggcgcatcgtagagatcaatcccccccccacggtcaggagtaccacccgatgcgtatgcgccgaatcgccgtagccgtcgccatggccgccgccgtcaccgccccggccgtcgtcaccgacgtcgcggccttcgcgaaatcgccggcggtcagcaaacacggcgatgacagaaacgacaacaagggcaacggcaacgccggcaacaagggcggcgacaacagcaacaagggcggcgacaaggccaggtccaagaaggtcgccttcgccgccgagggcacggtcaccgcggccgacgccgcgtcggtcaccgtcgcggtcaagggcggcaccaaggacgtccgcggccgtaccgtcaccttcgccgtgaccagcgccacccggatccggctcaacggcaagcgggtcgcggccaccgcgctggccgccggggcgaagctcgaggtttcgggcacccgggtcgacacggtctacaccgcggtgcagatcgaggccaccctccgttccggccgccccaagccggcgccgtcgcccagcggcagcgcgacgcccaccccgtcgccgacggcgacgccgtcacccagcggcagcgcttccccgtcgccgagtgtcagcccgtcgcccagcggcagcgctaccccgtcgccgagcgacagcccgtccccgacggataccccggaccccaccgacagccccagctgatcgacgcgtccgcgccagggtggtgcccaccgccctggcgcggacccgtttccgggtgcaccgccgccaaacgctaatagcgcggccgatccggccgatggctgcaaacgagaaagcagaccgataccgggggaggagtccgcgtgcgcgaccgcgtgctggtgccgatcacgctgctgtccctgctggtgttgaccccgtacgtcgtcggcctgggcaccgaccgcgagcggctgatcctctgctggatcgtcgccccgctcaccgacctgggcatggccgcgctgagccggcaggccagccggctgccgggttcgcccgcggcgaacgcccggttctggcgggcgatggcggccgccggtctgttgttcgccgtcggcgacaccgtgcagctcgcgtcggtgctcgccaccccgggcggcagcgtcttccgcctgcatccggtgcagagcctgctgggcgtgctcggcgtgatcctgatgtgcgtcgccggcctgcgacatcccggccatctgtggtcgcgcggcacccggatccgggtcgccctggacgcggcgatcgtgtacagcgcggccggcgtcgccgtctggtgcctgctcacccggcccggcgtcgcccaggccggcgcgatggggtacgccgccgccacgttcggctgcggcgtgctgctgatcggcggtttcctcgcggtcaagctcgggctcggcggcagcagcccgatcgccctgccggccgcgatcaccatcgtggcgggcgccgccgtgcaggcggtcggcaacgccctgctgcccagcggcagcatccagggtgtcaccgtgccggccctgctgatcctgttcccctgcctgctcacgctgcacaccccgcggctgcacacgctggccgtgcgggcccggcagcgggcgcccgagcggcggtccggcacccggcgccggtacagctcgctgccctacctgggcaccgtgctgtgcgtggcgatcctgctggtggtgctgctcgtcgagggtctcggggtgtccgcctggggcgcgctgatcggcctgctgctcaacgtcaccctggtggtggcccggcagatgctcgccctggcggagaacaacacgctgctcgaccagctggacgagagcctggccgagatccgccgccgcgagcgccggcaggacgcgctgctgcggcacgcctcggacatcaccgcgatcctcggcaccgagggcgtggtgcgctacctgaacccggccgtggagcggatcatcggcggctcggtcgacgactacctgggccgcagcctgttcgacctgatccacccgggtgacgcggcccggatccgggaggagatgaccggggtgttcgccgtccccggcgccaagggcaccttcgagctgcgcgcccagcacgaggacgacagctggcgctggctctcggtggtcgcggtcaacctgatcgaggagcgcggcatcggcggcgtggtgatcaatgcccgggacatgaccgaggagcgggaactgcgcgaacggctgcgcttccaggccgggcacgacgcgctcaccgggctggcgaaccggcggcagttcaccggccggatcgccgcctgtggggcgtccgaggtggccgtgctgctggtcgacctgaacgggttcaaacagatcaacgacacgcacgggcacgccaccggcgacgcagtgctgcggcacgtggcggaccggctgctggactgctgcggccccggggacctgccggcccggctcggcggcgacgagttcgcggtgctggccgcggcgggcgcgccgggagcgcaccggatcgcggaccggttgcgggcggctctgacggcgcccgcggagatcggtgaccaacggctgtccgtcggcgccagcatcggcgtcgcggccgggccggccgaccagccggacaacctgctgcacctggccgacctgcggatgtacgccgacaagcagcgctcccgagagttcgcatcgtgacccgagcctggcgtccggccgccctcacgggcgcggtcgcgctgctcggcaccctctggtacgtctggtggtgcctcgccccggccggcaccttcgcggtggcgtacgtgttcatgccggtcggctcggcgctcaccgtggcggccgtccgttcgctgcgccggtcgaccgcgatgcccccggccggccgtcgcttctggctgctgctggagggcggcgccgcgctgatgacggtcggctacacgatcctggcggtcgccgccttccgggccgctccgcgtttcgccgcgatgccgctgtcggcggcgatcacggtcgggctgggcctgctcgccgcgatcgccgcggtcgccgtcgtgccactcggcatcaccagctggtacgagcgcggcaagcagtggctggaccggtccatcgcgttcctcggctgcgccgccgtgctctggcacttcggcgtggctccgatgctcagcggggcgatccggtggagttccagcgtgctcgccgtggtgctgctggcgttcgtgttcgcggccggcgcgatcaccaaggtgtcgtacgtcccgggtggcccggtcgaccggctcgcgatccgcctggtggccggcaccgggctggtcaccgccgcgttcgcgatactggcggtggcccgcccggtcgacggctcgattccggcccaggcggttctgctgccgctggtgccggtgctgatcacgctggccgtgggccgtcagcgcacggcgccgccgagccgcccggcccgctccggcacctggctgccgtacctggcgatgctcgccgccgacgtgccgctcgcgcatgtgctgttcggcggcgccacggtgggcgaggcgatccacgagggccggatcgtcgtcagcggaaccgccctgatcaccacgctcgtctcggtccgccagtgggtggtcaaccgggacaacgcccggctgctgcgcgaccgggaggcctccgatgcccggatgaagtacgaggcgacccacgactcgctcaccggcctgggcaaccgggtgctgttccggcagcggctggagaccgcgctggccgccgacggcgccaccgtgctgctggtcgacctggacgacttcaacacggtcaacgactcgctcggccacgacgtcggcgacgagctgctgatcgctttcgccgagacgctgcgcgccgcgaccggcgccgacggcgaaccggcccggctcgccggcgacgagttcgcggtgctggtcaccgcgcccggccaggaccaggcggtggtcgaacggatcatgacggcgatcgccgcgccgatcagcgcgcaccgtctgctggtgcacgccagcgccggcatcgcggcggccccgccgggcgccccggccggccaggtgctgcgcgacgcggacgccgccatgcacaccgccaagcagcgcggcaaggccaactgggtgcggtatgcggccggcatggagaagcccgcccaggcggccgcccagctcggtggcgacctgcgccgggccctggacgccggtgagttcaagctcgtctaccagccggtggtggacctgcgcaccggccgcacggtcggtgtcgaggcgctggtccgctgggcacatccggagcgcggcatggtctctccggccgacttcatcccggccgccgaacgcaccgggctgatcgtcccgctgggccgctgggtgctgcgcgagacctgccggcagaccgccgcctggctcgccgagttcggcccggacgcgctggacaaggccgcgccgaacgtctccgtccggcaggtgcacgaccccgacttcgtcgccgacgtgcgggccgcgctcgccgacaccggcctgcccgccgcccgcctggtgctggaactgaccgagtccgcggtgctgcgcggccaccaggtcctcaaagtgctgcacgaactgcacgatatgggcgtccggctggccctcgacgacttcggcaccggcgagtcctccctgagcctgctgcgcaccttcccggccgcgatcgtcaaactcgacaaatcattcgtcgaccacatcgagctggacgagccggacagcccggcggcgaacgcccggcaggcggtggcccgggcggtggtgcaactcgccgacgcgctcggcctggacacggtggccgaggggatcgagaaccaggagcaggccgaccgcctggcccggctcggctacagcatgggccaggggtatcacctggggcggccggtggctccggaggagatcacggcgcgcctggcggcggagcaggtgtcgttgcggaccgctgcctgagatcaccttcttcaagcggatgtcgtgcgctgcggccgataactgatcgctgctcccgccgctcccgggcacggcgattctggccgctggcgcgtccatgacgaatcgccgcgccctaccacccgcgtgtggtcaccgcatacgccgtcccgccacgccctcccgtctcgccacgccctcccgtctcgccacgccctcccgtcccgccacgccctaccgcgtcgcgcgccctcccgcgccgcgcgccctaccgcgtcgcctttcgtcacgccgtgggttcgctgcgtggcggcggctgccgtgctctgccaccaggggggtgatcgtgcagaggtcggcgccggtgacgccagtagagttcccgggaatggacacggcggacgacggcacattcacggcgcatgcgctgacggcgtggctggagcggctcagcttcaccgacctgcccgaggcggaggcgacggcgcggatcatcgacgcggtcgtggcgtggggtgcggcacagcggtggcgcgtctatcggcgcgcgccgagcgtggtgccgatgccgccgccgctgcacgggaattccgtgctggacgtggcctgtgcccggccgggcggcgccgcgccgatcgcgatcgaggtggaccggctggaccggcagcgaaccgtggacaaactgctcgccgaggcggccgccggccgggtggcgatctgggtgcgctgggggaccgggccgttcccgccgccaccgctgcccgtgcatctggtgatcagggaggccacccggcgctccggcaggtggcatacggtgtccggacgaccggccccgaaccattcgggcgccgctcctgtcgtcgccgaagccgaggagctgccgtgggaactgtgaccgagagcccgtcccgactcgcctggcgggtgaccgagccactgcacgcgctggtctacttcgtgccggaggcggccgcggcgtaccgccgactgggtcttgatccgatgggtggctatttcgcgctgcgcgccgccgccctgggtgccgccgggccggagctggtcgccgccacgttctacaacttcaatccgtccgtgatcggcaaggtgctgccggccgcctgggacgtcgcctccccgcagcagatggtcgagacgcgcctggcgatcgccgacgccgcgctcacccgcggtctgggcgccgaaaccctggcgggcccggagatcgccgaggccgccgacctcgcccgcacggcggcccggcacgcgtccaccatgccgcacggccgcccgctgttcgccgcgcacgccggcctgccctggccgaccgcgccccacctggtgctgttccacgcccagatgctgctccgcgagttccgcggggacgggcacctggcggccctactgagcgccgggatcagcggactcgaatcggtggtgctgcacgtggccagcggcgagatcgaggagcgcttcctgcgcggcacccgcggctggaagcgggagcagtgggcggcggccgccgacgccctgcgcgcgcggggtctgctcagcccctccgcggcccccgcagccgccgcgcccgatcccgcctccacgcccggcgctgtcgccccgtccgcctccgcttccaaggctgtttccgcctcggcgttcgccgcggcgtccgctgccgccgccgcgggaacgggcgagcggacccgggacgagctctccgaggcgggacgggctctgcgggccgagatcgaggccaccaccgaccggctggccgagccggcctaccggattctcggcgatgacggctgccggcgactggccgagttgacccgtccgctgagccgcaccctggtcaaatccggattcctcaatcctgtggcgcttctcggttgatatctgaatcacttgtcgtagcgtgatcgttgggtcacgcttagttgcgtgattcgacagcagcggcacccggcatcgtggtgggaccagttccagcaggcgtccgacaagttcgacctggccatcctcacagagagtctgggcgacgagatcgcgccgaagatctcctcgccgctgctgcgccgcgaggccgagatcgccctcgaagtgatggtccggcatctgaacaagccggccagcgaggaactcgccgagcgcgccaccaagggcgtacagcgcctcgtcgaaaccgtcgcccgcctccaggagcgctccggcgacggtttcgagctgcgcgaggcccaggccctgatccacctgttggagggcaagaccggcgacgccgccagtgaggccgaggagttcctgaagagccaggtcatccttcgtgccttcgtcgccgccctccgcctggaacgtttcgactccaccctggccgtcaaactcctcgccgccggccacgacccggccgccgcgctgcactccggccaggtgatcggcaagtacgcctggtggcccagctggctgctcaaggtcgtcaccgagcgcgccatggccggcaccctcgacgaggacacggtcgccgccctggaccgctgcgcgtacgccgagctgagcccggcccaggcccgcatggcccgccgcctcctggacggcgaggaagcgttgatcgacgcctcctcggtccggctggaagccctgggcgaggtcgactccgccgaaaagctgcgtaagggcgacctgaccatggtcgcgctcgccgcccgcctgatcccgatctagggccatcgacctgcgagccggccacgccggcctaccgtggctcccggcgcccatgcgccgcatccgtgcgacgcccggccgttcacatcgacggtggatgattgatagtcggtggttccgctctaccgcctgggtgatttgccgggtttggcgcgcccggaacggacaactgatattcatctgtcctttgttgacagatactctgcgttctagatccgctacccaaagcaacatttggggaaacagaaggttaacgaacgcggaatcttgtacacgttacgttcgcccactggcagcggggtgggccgaccgttcaccatcagcccgtgactgaaacatccgtgatcctcgcgctggtggtcgtgacggcactcgccttcgacttcaccaacgggttccatgacacggcgaacgcgatggccacctccatcgccaccaaggcgctgcggcccaaaaccgccgtggcgctctccggagtgctgaacctgatcggcgcgttcctctccgtcgaggtggccctgaccgtcaccaacgcggtcgtcaagatccaggacaagtccggggcgccgaaagccgcgctgctcgcccacggcgggacgacactgctcctgatcatcctggccgggctggtcggcggcatcgtgtggaacctgctgacctggctcgtcggcctgccgtccagttcgtcgcacgcgctgttcggcggtttgatcggcgcgaccgtggccgggctcggctgggccggcgtgaactggaacggcgacggatcgaagctcgacggcgtggtcggcaaggtactgctgcccgccgtgctctccccggtgatcgcggcggtcgtcgccgcggccggcacctggctgatcttcaagatcactggcgggatcgcggcccggttcaccgagaagggcttcaagtggggccagatcggatcggcgtcgctggtctccctggcgcacggcaccaacgacgcgcagaagacgatgggcgtgatcaccctcgccctgatcgcgagcggtgactggcacgacaccaagaacatcccgctgtgggtgaaggtggcctgcgccctcgccatcgcgctcggcacctacctgggtggctggcggatcatccgcaccctcggcaagggcctgacggacatcaacccgccgcagggcaccgccgcccagtccggcgcggccgcggtcatcctggcgtccagccagctcgggttcgccctgtccaccacccacgtggcgaccggttcggtcctcggctccggcctgggccgccccggcggcgccgtccgctgggcggtcgccggccggatggtcgcggcctggctgatcaccctcccggcggccgccgtgatcggcgccgcgatgtggtggatcggccatctgatcggcggcgtccccggtgccgtcgtcgtcttcctgctgctggtcgccgcctcggtcgcgatgtggctgcgttcccgggcccaccacgtctcctcggagaacgtcaacgacgactgggacacctcgtcgcccgcggcccccgccgacgccgcggtcgtcctcgccgccgaccccgaagcgccggccatccttctcggcgcggacccggcgtcggatgtcaaggttcctgattccccggcctcgctgacctcgccggcgacggcggccaccgacccgggccgcgtggcctcgaagaactgagcggagctgacatgcacaacctcggattcgcgctggacggcgcgtggcgggtcctgctcgccggcctggttctcggcgccggcctgccggtgctcttcgccctcggcatccgctccctcgcctggggcgcgggcgaagcctcggtcggcccgtcgggcgtcacggccggcgccaagcacccgctgggcacggtcctcggctacctgctgttcgcggtggtcatcgccggcgtcctgctcggtctgaccttcatcgtcgccaccggcttcggcgacaaactcagcttcgagcacatctacccgacgatcgtcccgaagtaacgatcacgccgcggggaggctgctcccgtcagcgatcgccccgagcagtgaccgcgtcgaagcgacggttcgcggcggcttgcgatggcccggtgggaaaccaccgggccatcgccatgacggctcggaaacccacggcggatcagtgaagaccgatgcgccggtcccggccgtgagctgacgccggaccgcggcgccgcctcaccgcggccggtgccggcctcaggccaggctgcgggccagtacgccgatgtcggcctgatcggtgaagagcccgtcgatgccggtgcgcaggaacgtgatctgctcgtcgatcgcccgaccgtaggcgttcgggtcggtgcccacccgcagctcggcgggcaggaactggttctccgcgcggaaggtgtacgggatcacctgcaggccggcgtggtgcgcgtccttgaccaggctggtcggcgcggccagggtgccgtcggcgttgcgggggatgatctggctcttgtccgggccgacaccgtcgacgtattcggacagctcctcgaggccggccggggacaggtagtcggcgtaggtgcgcgagtcgttgaacggggtgccggacgcgctggtcaggaagatcagcggaacctccacccgatgacggtcggccagcgcgtgcaggttcttcgactcgaaggactggatccagaccctggcgccgcggcggtccagcccgttgcggcgcaggatcttgacgagcggggtctccagttccagcccgaggttgcggaagaacgtggggtgcttggtctccgggatgaccccgaggtcgcggcccagctccctggacagccgcttgcgcaggtcgagcagctcctggaaggtcggtacctcgaaccgagagtcgaagagcgtgttgtgctgccggacgccgggcagccgttcgaccgcgcgcagcgtcttcagctcggccagcgtgaagtcctgcgtccaccagccggtgacgctcaccccgtccaggacgatggtgcgcttgcggtcggcgaactccgggtgcgacgccacgttcgtggtgccaccgatctccggctcgtgccggcagaccagcaccccgtccttcgtgctgaccaggtcgggctccaggtagtcggcgcccagccgggcggccagctcgtaggaggccagggtgtgctccggacggtacccggaggcaccccggtgccccaccaccagcgaggtggtgtgcttgctgggccggtgtccggcaccggtgtgctgctgcgcaccggcgaacgccgggctcgcgacggccccacccagcgccggagcggcggcggccaccgcgccgaagcgcagcacctgacggcgatctgccacgtttcctccacggaatcccgggtccggccacggtggccggattcaccgagaggcagtcgacgggacgcatgcgtcgcccaggcgacgatctcgtggcgtgtccgccaacgcccggccaatctcgtcccgaccggtcggagatcggcaggcgtgtctcgctcgccggtgagtgccccgcggtgcctcccctcgtcctccgccatcatggcgccgtcacggccggcggccggcgagcctcgcggctcgggcgggacccgttgcctccggtggcgacggcggtcagctcggcgttgacatgccgacaacccggatcgggcatacgacaatgcttccgggcgaccgtacgatctgctcgtgcccgtgcccctgcgttcgctcctgggagaaccgagtcctcccggcgcccctccgctgtcctggcgggacgggctcctggtcgccgtctgcatggccgccgccgtgctcgaaggggtctttcgtcccgatcttccgcaccggatggtcgccgtcgcgctcgccgcgggcctcgctccggcgcttctgatccggcgcagccgtccgctgctcgcggtgaccgcgatggtcaccgccacgcttctcgccccgctgctcaccgacggcgcgccgccggaggagtattcgctggcctaccttctgctgctgccctatgcgttgttccgctggggctccggccggcagatcgcgatcgggctcggcgtgatcgtcggcaaacaggccctggcgtacgcgttcgggcaggtcgacgtcggtgacacgatcggtggcacggtgctggccggggcgatcctggcactcggtgcggccgtacgctaccggaccggcgcccgcgcgcgggagagggagcaggtgcggctgcgcgaacgtgaacgtctcgcccgcgacctgcacgacacggtggcgcaccacgtctccgcgatggcgatccgcgcccaggccgggctggccacctcggccgcccacccggacgcggccgcggacgccctgcggctgatcgaaaccgaggccaaggaggcgctggccgagatgcgcaccgtgatccgcgccctgcgcaccgacgaaccggacgcgccccggctcgccgacctgatcggtctcgcgacgggcgccggaccgcgggtggacatcgaggtcggggcggatctgggggcggtggcgccggcgatcggggcggcgatctaccggatcgcccaggaggcgatcaccaacgcccgccggcacgcacggggcgcgacccggatcacggtgcgggtcgcggcggacgcgacgcaggtgcggttgcgggtcgaggacgacggcgcggcaccgggtccgctgcggtccgggacgatggcggggtacggggtgagcggcatgcgtgagcgcgccgagttgctgggcggcacgtgcacggccggcccggccgccgatcgtggctggtgcgtcgaggccgtcctgccccggccgatcctccccggcgcggtgacccgatgaccgcctcccggtcgctgccggctcgtccccgtccgggcggggtggtcggatgaccgtgcgggtgctggtggcggacgatcaggagatcgtgcggaccgggctgaccctgatcctcaacgcgcagccggacatccaggtgatcgccgaggcggcgaacgggtatcacgccgtcgagctggcccggcggctgcggcccgacgtgtgcctgctcgacatccggatgcccggcgtggacggcatcaccgccacccgggaactcgccgggcccggcgtcgccgacccgctggcggtcgtggtgatcacgacgttcgacctggacgagcacgtgtacggggcgttgcgggccggggcgcgcggtttcctgctcaaggaggccgggccggaactgctgggccaggcggtgcgggcggccgcggccggtgacgcgatcatcgctccggcggtgaccgcccggctgctgggggagttcgcccggggcccgcaccggggcgcgtcgcggcagccggccgagccgctgaccgaacgcgaggagcaggtcctggcggcggtcgccggtgggcggacgaacaatgagatcgccgctgacctccacatcagcctcagcaccgtgaagacccatgtggccagcctgatgaccaagctcggggcgcggaaccgggtggagatcgcgatgtgggcatacgagaccgggcgccggtaacggccgaaagtacggttcttccctgaatccgcctccggggtccgaaccgtactttggaccggtgccgggaatcctcccggccgcgaccatcgacgcatgaccactgcggcggggatcgatcgggcaccggacgacgacaggatgcgagccggcggggacgtgcctgccggccgcgccgggaaggatgccgcgaaggaagggcgcggtgcgcgacgtccgcagcggcggcggcgtggcggctggcggatcccggcgggtctgatcgcgctgagcctggtgccgtcgatcgcgggcgcacaccggctcggggagctggcgacgagcgcgccggtcaccgaggagaacgcgcggttcttcgcgatgccgctcccggtggtggcgcacatcatcggcgcgatcgtctacagcgtgctcggtgcgttccagttcgcgcccgccttccggcgccggcacccgggctggcaccggatcgcgggccgggtgctggtcggggcgggcgtgatcgtggcggtcagcggcctgtggatggcggtgttctacgatctgccgccgatcgacggtccggtactggagctcacccggctggtcgtcggcaccgggatgctcgccgcgctggtcctggccgtggtgacgatccgccggcgggacatcgccgcccaccgcgcctggatgatccgggcctacgcgctggcgatgggcgccggcacgcaggtcttcacccaccttccctacgagctgatcgccgggacacccggtgtcgggacccgcgcgttcctgatgggcgccggctgggggatcaacatcatcgtcgctgagtggatcatccgaggccgtcccggtccacgcgcccgccgcccggcctgaccctccgctccgccgtggccgggacggcctgcccctcagccccgccccggacgggacggccgccggcgtcctagggagaccggtgagcggtggtggtctggtgagcgggaacggtctggtgagctcagcccgtggcgcgaggtgtcccgcgcccaggtcggtggggagaggcgtttcccgcccgggccggtccggtgaaggggtcgcggcccgggcgggtccgtggtcagaggcggagctgcggccagtccagcagaccgtcacccaggtcgcggacggtggccagcaggcccaggcgggccgcccggatcgccgggtcgtcggccatcaccaggacgtcgtcgaagaacgtgttgaccggggtcaccagccgaccggtggccgcgacgaagcggggcagatcggtgcccgcatccgggccgagagcggcgcggaccgcggtgaccgcgtcgtgcagggccagctcggccggctccttcagggcgcccgcgtcgtaccgcgcggtggtgccgtccgggacgatccgccgggcccgctggatcgccgcggcgaccgccgcgaaatccgggtcggcgacggccggggcgagctgcgctagcagcgtgtcggccaccgacgggcgggcgaagtgcggcagcaccgcacggatccggtcgaccggccggccctcctcggtcagtgcctgctccagacgtttcgccaggaagtcggccaccgccggaagcacctcggcggcgaccggcaccggctgcgcggccgcggccagggtgagcgcgtcgaccagcgacaggtcggcgaactcgggcgtggcccggtgcacggcgagcaggccgagcaccgcccggcggacggcgaacgggtcgctggagccggtcggcagcccgaccgtggcggccaggccggccaccaggtcgagccggtcggccagcgagagcagggcgccgggcagcgtccggggcagggcgtccccggtgttgcgcggcagttccgcctcgaagaccgcctcggccaccggccgcgactcaccggcgtgcagcgcgtagtcccgggccatcaccccggccaggctggtcatctcggtgaccagctgcgaccccaggtcgaacttgaccagctcggcggcccgatccagggtcggcgagcccaggtcgaggcgctcggcgagctgcttggcgagagcgccgatccggcccgcccggtcggccatcgagcccagcttgtcggtgaaggtgagccggtccagccgggccttcagctcggcgagcggggtgtcgaggtcggcccggtagaagaagcgggcatcctcgtatcgggcccgcagcaccgcctcgttgccggagcggaccagttcgacgtcgaccggcccgttcgccaccgtgacgaacatcggcagcagccggccgtcctcgtcgcggaccggaagataccgctggtgcttgcgcatcaccgtggtcagcaccgcgtcgggcagcgtcaggtaaccctcgtcgaacgtgccgagcagcggcagcggctgctccaccaggtcggtgatctggtcgatcagcgccgcctcgccggccacgtccaccttcccgtcggggtagacgaggtcctgcgcgccgaccacgatcagctcgcggcggtcctcgtggtcggccacgatcccgttgacgccgagcgtctccaggaacgtctcggccgacgcgatctcggcgaccggcgggacggcggtgcgcagcagccgggtctgccggccggcggccagcgtggacaccgcgaccggcaccacgtcgtcgccccagagggcggtcagccagcgcagcggacggctgaacgccagcttcgggtcgttccaccgcatgttcttggcggcccgcaggccgccgacgaccttcgccaggacggcggccagcacctgcggcgccgcgccaccggcctccggcttgcggacgacgacgtgcggtacgccgttgaactccgccgtctccagctcggcgagcgtcgcgccctgcccgcggaggaacccgtcgagcgccttggtgggggtggtgccgtccgcggcgtacgccgcctgggtcttggggcctttgacggtgcgcacgtggtcgtcctcgcgggcggcgaccgcctggaccaccgcgatcaaccgtcgcggcgtgccgaagacgcggatctcgccgtgccccagccgggtgccggccaggccctcggtgaccaggcgcagcagctgctcccgggcgttgcgcagttcggccggcggcagttcctcggtgccgatctcgaagagcagggtgcgcggcgtgtccccggtctgcgtgctgccggccgcgcgggccgccgccggctccccggtggtgccgagcgggtgttcctgttccgcgcggcgggccacccagagcttggcgacctccccggcgaggcggcgcatccggccgaactcggcggcccgctcggcggtcgacacggcgccccgcgagtcgagcacgttgaaggcctgcgagcatttgagcacgtagctgtgcgccggcacgggcaggccggcgtcgatcatccgctgcgcctcaccggcgtacagctcgagcagccgccggttggcgtcgatgtccgcgtcgtcgaggtagtagcgggacatctcgtactcggcctggccgaagacctcgccgtagctgacccccggcgcgtactcgatctccttgaagtgctgcttgtcctgcagcgccatgatgatccgctcgatgccgtaggtgatctccaccgacaccgggtccaggttcagcccaccggcctgctggaagtacgtgaactgggtgatctccagcccgtcgagccagacctcccagcccaacccccacgccccgagcgccggcgaggcccagttgtcctccacgaaccgcacgtcgtgcgcggccacgtcgatgcccagcgccgccagactcccgaggtacagctcctgcgggttgcccgggtccggtttcaggatcacctgcagctgggtgtgggtctgcagccggttcgggttctcgccgtaccgggagtcgtccggccgcaccgacggctccacgtagacgacccgccacggctccggaccgagcacccgcaggaaggtggccgggttcagggttcccgctccgacctcggtgttcatcggctggacgatcaggcatccctgctccgtccagtacgccgtcaaccgggccagagcctcctgcatggtgagcatgcgccgaagtctaggcgtccccgctccacgcaccgtaagcggttacctccggcgagtcccgctccggggaccgccggcgaccgcctacgccagacgggcgaggacctcgctgaggatggtcgtggcggcgctggggagcagggtgtcggcatgccggtagcgggcatgcggggtgtgcgggttggggatggcgacgcagcgcaggccggcggcccgggcggcggtgacgccgtgcggggagtcctcgaaggcgacggcccggtccgcggtgaggccgagacggtgcagggccaggtggtagacggccgggtcgggtttgtcggccgggacctcgtcaccgcaggccaggacctcgaagcgggggaggtcaccggtgcgggccaggttggtgcggacccaggcgccggcggagctgctggcgacggcgaggcgcaggccgcggcgttcggcttcggcgagccaggcggagatgccggtggccaggccgagcgcggcgtgcgcccgctcgcggtacgcggtgcggcgggcatggctggccgaccggtcgaaacccggcccgaccgccgcggcgagggcggcgtagcggatctcgctggtgtcgccgccgtggtcggcgaagaatccggactcgtcgagccgcaggccgtgctgccgccactcccatcgccagctgtccagcagggtggtctcggtgtccatcagcagaccgtcgaaatcaaagatcagcgcctcgatcgccacccgtcggattatgcccagcgcccgcgcggcggcgggagacgggtgctgcgggtcagcgggggcggagcaggcggcgcggggtgcagtgggtggcggcgaccgtgtggcaccaggtggtgacggcggtggcgtccgggaagtcgccgacggccagggtgagccagcggccgggggcgccgcgtggatggtccaggtcggcggtgtgcagcaggatcaccgggtggtcactgctggccagggtgcggcgcagacgctggtgctcggccaggaccacggccgggtcgccggtggtggcggccagttcggcggcgaactggccggacagggtcagcgtggccaggtcgtcgcggcgggtgaagtcgagctcggcgcgggggtcggcggaggccggccaggactccgggcgggggccgaaaccggcgtgcggctgggcggcgggggtcagcgccgggggcgcgctgtgacgatcgaacgcggacaggacgatggcggcgaccgcggccgaggcgaacagggtgacggcggtggcggtcacggctgggtggcgcacgtgcacggggccctccgggtgtccggcgcgcgggacttctcgacgctaaccgcccagagcatcgatttccagggcatacctccggttcagccggacgggtcggcggcgcacggcgcggggccggcggggacggtggggcggggagggcccggtgggatgccccgcagggccgggtaccggatcgcaactcaactgcgaccgggtggcgggcgccggcggctcaagccgggggcggttgtgccgaccagtgggaccatgagcgtgggcagcggattgcacacagccggtcctctggtggaggctcccggcggcacgggcgcggaacccgatcggcaggtgctcctgctggccgaacttgtcggcttcatgaccaaggacaccccgtcggtccagcacgtactggacctgatgaccccgcacctgtgcgaggtggccgggttgaccgcggcaacggtgttcgagctggattcggagagtggcctgatggccgcgaccgcccagttcggcgagccggggcggcgcgaccagatggtcgccggcaaggtgttccgggcggcggccggtgggccgccggtggtcagtggtcagcagatggcgatccggctgcggatcggcggccagaccgtcggggtgctgctgctgaccggcgagaggctcgccgagctgcggccggacaccatctcgacgatcgcgctgcatttcgcgaccaccctgcaggggctgttcgcggagaaggcgcggcagttcgtggcgcacaccagcaccacgatccaggagctgttcgagaagggcatgaccgcgggcagcgtggaagaggcggccgagctgctcacccactcgtgcgcgaccgcgttccggaccgagcacgccgggctccacctgatcgacagcgacgggcggatccggtacgtctacggggtgggctgccccgacgagcggctggagcagttgcgcctgaacctggtcggcaagtccgcgatcgagtcgccggtctggcgcagcacggtcgagtcgggggagccggtgctgatcaacaacgcctcgacggccaaggtgcggccgggcgggatgaccgagaccctcgggctcgggtcgttcatcgcgatgccgttgatgaccggtttcggagcggtcggcatggtgctgtgcggcgactcgtccggcgcccgggagtggagcgggcgggaccggatcctggcccagcagctctccgccgagggtgcactgatcatggacagtgcccggatgcggcaggcgaaccgattgcacgtcgaggagctgacccggcaggcgttccacgactcgctgaccgggctgccgaaccgcaagcacctgctggaccggggcgacgaggcgatcgagatcgccatgtgcaccggcacccggctggccctgctgctgctcgacctcaacgggttcaagcaggtcaacgacacgatcgggcaccacgccggcgacgtgctgctgcagctggtggccaagcggctggacggcctgatccgcaagccggacctggtggcccggctcggcggcgacgagttctcggtgctggtcaccgggaacccggacgaccaggcggcggtccgggtcggcgagcggatctgcgagcggctgcgcgagccgttcgagatcgacggcaagccggtgcagatcggggcgagcatcggggtggcgctgttcccgcggcacgcgaccaacatcggcgatctgatgaaggacgccgacgccagtatgtacctggccaagcgcagcggcggtggagtgcacctgaccgcctgaccgcggacgacatcggtgggggcggcccggtccgggccgccccccgatgtgtttcgcgcggcccggaccggtccctcggccggtcggaagcgccacggctccggaccggggtcatgggttgttcagaagccccagggctcggcgggaaggcagttgccgggcttgccggggggctggtccgagggctggtagaggaccctgccggtgggatcggcccagcatcgggtgacgcgatccgcggtggcggggaacagcggctcctcgtggatcggctcgccggccgcgtcgtaggcgatcaggcgggtgcccgggccgagcacgtcgccggtgccgagcaggccgaaggcgccgttcgcgaggctggccgggacctggtgcggcccgtcgacggcgaccagccgggccacccgggagctgacccggccgaccacgtccagctgggcggggccgccgcgatccgacgagccggacatcagcacctccaccgggccgggcagccagtcccgccggccgtcccacgggccgccggtgaaaccgccgtccgcctcgatgcggacgccgaagacggggcgggcgatctgggccgcggagcaggccgcgaatccgcgctcgttgacgaataggacggtggcctggccatgggtttcggcggccaccgcgacatcggccgatgacaccgcgggcaggtccgcgggctcgggaaggcgttcgacgatctcggcgcgctgggcgacgcagtgatcgaccacggcctccagggtcgacgacaactcaccggggccgagggcgatcgtggtgggcagcggctgcggccgtacgaaggcgatcgcggaggcgacggcgatcgtgagggacgccgcgatcgcgagccgcagcgcgcgccggtcgcgcttttccggcgtgtgcagcagcgtcgcccggatccgcgcggcgtgggccggcgggaggtcgcgctcggccgggaggtccaggtcggtggtcatcggtgtccctccgtaagcgtctgatggtttccggtcagcgtcgcggcaggcaagacgggcggcgcggcggcagaggcaggcggcggagcgggagaggcgggcgaggcaggcggcggagcgggagaggcgggcgaggcaggcggcggagcgggagaggcgggcgaggcaggcggcggagcgggagaagcgggcgaggcaggcggcggagcgggagaggcggacggcggcgcgggggagagggaacgggtgaggcgggagcgcgcccggctcacccggctgcggaccgcggtctcggtgatgccgaggaccgcggcggcttccgggtaacccacgccggaccagaggcagagggcgacggcctcccgttcggcacggggcagtccccggaccgcggtcaggacctcccgcatgcgccgttcgtcgtcgagccggccggccacgtcgtcggcgtgatcgcatgcggtctccggggcgggagagctcaggagacggcggcgccagcgacgcacggtccgctgttcggtgcgggcgtggttgccggcggtgaccagcagccacggcagcgcggacccgtcgaccagccggatgtcggtgcggcgctgccaggcggtgaggaaggtctgggaggtgatctcctcggccagcgaccatgacccggtgagccggaaggcgtggttgtagacggcacgggagtgccggtcgaagagtttcccgatgtcgtcgtccacggtctgcatcgtcacatccccctatggccgccggcgcccgggctgttgcaggacagcggtgaacagccagttgcccaagtgtttccggatcattgcgctgggagcgctcccatgtaatgctgtccgcgtcgggcaacgatccccaccgatgcgttggccgtcgctcccattggcgtcgatgaatgacgccgccgtaaccccgtctcgaggagtcctcatgagacccatctccacccgggcccgcgccctcacggcagccgccgccgtgagtgtcgtggccggcgccggcgcggtcgcgatcgcgtccgaggccagcgccgccgccggctgtcgcgtcgattattcggtgaaccagtggagcaccggcttcaccggcaacgtcacggtcaccaacctcggtgacccgatctccggcggctggaacctcacctgggacttccccggcaaccagacgatcacccagggctggagcgccaccatcgcccagtccggccagcatgtcaccgccaccaacccgtcgtgggccacctccatcggcaccaacgggacggcgaacttcggcttcaacgcgaactactcgggcaccaacaccgcgccggccgcgttcaagctgaacggtctcgcctgcaccgggacggtcccgaactcgccgccgccgtcgtcgagcggaccgtcgaccggtccctccaccggtccgtccaccggaccctcgaccgggccgtcgacgaacccgggcaccaaggtggacaacccgtacgccggggtgaagggttacgtcaacccggagtggaaggcgaaggccgacgccgagcccggtggcagccgggtctcgaacaacccgaccgccgtctggctggaccggatcgccgcgatcgccggcacctcggacagcagctccaacggctcgatgggtctgcgggaccacctgaacgccgcgctcgcccaaggcgccggctacatccagctggtcatctacgacctgcccggccgggactgcgccgcgctcgcctccaacggtgagctgggcccggacgacctgccgcggtacaagagcgagtacatcgacccgatcgccgcgatcgaggccgacgcgaagtacaagaacctgcggatcatcaacatcgtcgagatcgactcgctgccgaacctggtgaccaacacctccggccaggccggcggcaccgcgatgtgcgacacgatgaaggccaacgggggatacgtcaacggcatcgggtacgcgctgaacaagctcggtgcgatcggcaacgtctacaactacgtggacgccgcgcaccacggctggatcggctgggactcgaacttcggcccgaccgcggacatcatgctgagcgccgccaaggcgtccggcaacgtcaacaacgtgaccggcttcatcaccgacacggcgaactactccgcgctgcgggagccgttcgtgcagccgaccaccacggtgaacggccagagcgtccggcagtcgaagtgggtcgactggaaccagtacaccgatgagctgacgttcgcccaggcgttccggcagaagctgatctcgatcggcttcaacagcaacatcggcatgctgatcgacacctcgcgcaacggctggggcggctcggcccggcccaccagggcgagcacctcgaccgacgtcaacacctacgtcaacgagtcgcgcatcgaccgccggatccacgccggcaactggtgcaaccaggccggcgccggcctgggtgagcggcccaccgcggctcccgagccggggatcgacgcctacgtctgggtgaagcccccgggtgagtccgacggctcctcctcgctgatcccgaacgacgagggcaagggcttcgaccggatgtgcgacccgacctacaccggcaacgcccgcaacggcaacagcatgagcggtgccctgccgaacgccccgatctccggggcctggttctccgcccagttccagcagctgatggccaacgcgtacccgccgttgtcctgatctgccggtgatccggacccccgccccgatcatgcccggggcgggggtcctaccgtgtccgacgatgaccgatgaggtgcagtggcggatcggcgggcggcgggtggtcgcggccgccgccggcgtgaccggccggcgctatgaccggaactacgacgtcttccacctcgacccggaccggccgctggccgtcgtcgccgacggaatgggcgcgggggagggcagcgcggccgccggtcggatcacggtgcggaccttcgtggcgctggccggcgatccggccccggccgcgctgcgggccgtcacggcgcgggcccacgagggcgtacgcacgcaggtccgaacccgggacgggctgaccgggtgcacgctgaccgccctgaccgcggtggccgatgacgacggcgccgccgtacggatcgtgcagctcggtgactcgcgcgcctaccgcctccgggacggcctgctcgaactgctcacggtcgaccacacggtggcctggctgggcctggtgcacgggtggtacgccgcctccgacccgcgcgcggaggcggacggatatcgcctcatccgttatgtcggacatccggatcgaccggagccggacgtggtggaggtcgcggtgcgccccggggaccggctgctgctctgcaccgacggggtgtcgggccagctcgactacccgactctgggccggctgttgggcggcgctggcccggccggggggtctagctagctagcgggcgctgctggaggctacgctccgggccggcggccgggacaacgcgacggcgatcgtcctcgcgatctactgacgacctactttttcacgaaaaatcggtacacagcgtggtacgggactgcgatcggctgattgcccccgcaggacttcgtcggcgccacgccaccctgggtggcgatccgctgaatgtaggtgacctccccgaacagcccgccgccccggttcccggtggcccgatacagcacctgcggcacgtcacccgccccggcgcccggcgcgctgaccgggtcggcgcccgccaccgtcgagccgtcctggtcggagacccacgccggcccgcggaagtgcaccgcggtgaccttccggaccgggttcacggtggccccgttgagcgacgcggccgcttcgagcagctgccacatgctgcgcctgcattcgtagatctgcacaccgcgggctttgaggacagcgtgcaggacattcccggccggcggctgcagcgccgtcgggaccgggggctcaccgccgaggaagccctcctcccgggtggtggccgaccggtcggcgaccgcggctcggccggccatcgcgggtcggtcggccatcgcgggtcggtcggccatcgcgggtcggtcggcgaccacggctcggtcggcgaccacggctcggtcggcgaccacgggtcggtcggtgccggcgaacgacacccccgccggcaggccgacggagacgagggcgagcgcgccgatcccggcggcgatcgtggcggtacgggtggtcatcgagctctcccggggacggcggcacggtggatcagactaaagggacagtaaccccaagagcccacataaccgtgcaattaccccaagatgtggtggatcacggcatcgtgtagaacccggtcggcagcgcctcgtcccgcccgcgcgccttccgggtgcgcgcccgcagccgcaggatcagcagcaacccgaggaagaagaacaccccgccgacgatcaggccgggccccagcaggttgctctggttggccgccgggctgagcgcggcggcgttgtcgctccgggtcggctgcacgatcggcgcggtggtgaccacctcgctgacgccgtcgtcgccggtcggcgaggtggcgggggaggcgctggtctgcggcgggcgcggggccggcgtggtggtcgccaccggcccggccacctcgatcgccgaaccggccgcggtgagccgggtgttgcgctcgtcgaaggcctgcacctcgaactgcacccggccgccgtcacggccgccgaaggcgagctgccaggtgccggtcaccgtccggtcccggcacaggatgcccgggtcgggctgctggtcgacgatggtggcggtgttcccggtgacgctgacccgggtggcgaactcgccgccgttctcgatccgggtcacccggatctggtcgagcgagacgtcgccgccgcggatcaccatggtccagcggaccttgcggcagcccgcctggttcgaggtgacgaccgcggtcaccttcggggcggcgccgccggccttggcggtggcgggcgaggtcaccttgagcgcgaagcccggcacgtcggccagggcgggtccggcggccgtggccgccgcgagggtgatgccggtcagtgtggcccagatcagcgcggtgtgatgccgcacgtcgttccccctcctcgtgacgtcaccgtcacctatgagttcgcctggccgggccgaatggttcagtcgcgggcccacttttccctcaagagccggcgggaaacgtcatttccgcaggtcagaccccagatgcgaaaagtagccggacgatcaccgaaaagagtggcggagaaatttcgcacgcgttcatccgaagccccgcccagcacgtaatccggggaggacacggccggggcgacgcaggggaaagcacgtcgcgggcgggtccggaacaacttgagcacggggcgttccccacgaacgccggcgtcccaccgcccacgggacgtgaccgttgcggaaaacgaggagtcaatggcccggtcgaagaacaaagagcgcaccgccagtagggtggcggtcgacatcggctccaccggcggtcggtccgtgcccccgagcgcggtgatcctgctggtggtctgtgtcctggcggcaatctgggcggtcgcgatgatgaccaagcccggccgcgtcggctacgtgtacttcttcatgtacgcggagtactacatgggggttctgaccctcgtgtcgctctccatcaccatcatggtcggcctggtctccaccgaccgcctggtcctctccatccggcagcgggtcttcctgcagtccacccaccggaccaccggcgtgatggcgatctcgtccctggcgttccacctgtggacgaagaccgtcgaggggcacatccgtgtcatcgacatctttatcccgttcatcgcccagggaaacaacctgttctacatcgggctgggacagatctccggatacatcctggttctggtcacctggagcggcctgatccgggcccggttcatcggccgcggcaagccgtggatgtggcgggcgatccactcgatctcctacctgatgtggccgatcgccctggtccacggtctgagcgcgggccgtgccgcgaagacctgggtgatcgtcagctacgtgatctgcgtgctgctggtgctgatcggcctggccgtgcggctctcggtcagcctgaaccggcgcaaggacttcgcctcggccgccggggtcggcgcggccaagccgtccgggaacgtggtgcccacctccggtggcggcgcccgcggccggttcggcgggggccggtcggcccgcgagcagaccaccgacctgctggcgcccgccgaaaccccggcggtgagcagctggatcccggccgcgcccgcggctagctagctagggccccgccccccgtcagcgccggcccgaagacgaccggtacgacgagcccacccgggcgatgccgcgccgcgagttcgaggacgaccggtacgaggagccggccctgcgcggacgccgccgggacgacgactactacgacgaggagccccggccgcggggccggcgctacgccgacgacgaggtggaagaggagccgcgcggccgccgggcggcgcggacctcgatggacgacaccagcacccggctgcgccgcgacgagatgaccgagaccggcacccggctgcggatcgaggacaccggcaccgggctgcgccgggacgagatgaccgagaccggcacccggctgcgccgcgacgagatgaccgagaccggcacccggatgcgccgctacgccgacgacgacgcctactacgacgagccggcccgcggccgtcgccgggccgacgccgagccccgctacgaggacgtcccccgccagcgcgccccgcgctacgaggaggacgacgagccgcgcggcggccgccgccgcgccgacgacggccggcacagccgcagcgagttcgtcgacctggccgacgaccggtacgccgatgacgacagcctggtcgacacgtccgcccgccgtgcccgccggccctccgccgacgtgctccgcggcaacccggccggccgcggccgggcccgggacgacgacgactcgtacttctcgcagctgcgcggtgacgtcaattgagcacggcacaggttcccccggtcacctcgatcggcatcccgcggatcaccgcgggctacgacgagtacggccgcctcgacctgcaggcgcaccaggaggtgcacggcgggtttgcggcgctgtcgtccggtgagctgatcggcctcaccgaccgcatcgagctgcgtgggcgcggcggggcgggtttcccgttcgcccgcaaggtgcgcgcggtcatcgactcctgcaagcgccaggacctgcccccggtgatcgtggtgaacgccaccgagggtgagcccccgtcctggaaggacaaggcgatcctgacccggtcgccgcacctgatcctggacggcgcggcgctggccgcggccgccctggacgccgaggagatcgtgatcggcatcgccgatgacggcatcgggcagaattcgctggccgccgccctggccgagcggaagatgccgtgcccgacccggctcgtcacggtcccgcaccggttcatctccggcgagggcggcgcgctggtccgcgggatcaacggcgaggcgcacatcccgcccggccgcaaggtccgctccagcgacaacggcgtgatggggctgcccaccctgctctccaacgccgagacgtactcgcagctggcgatcgcggcccggctcggcccgtgggagtacaactcggtcggcatcccggaggagccgggcacggtgatgctcaccgtcggcggttcggccaccaacccggccgtcgtcgaggcgcccagcggcaccccgctgatggacgtgctcaccatgtgcggcgcggacatcggccccggcctgctggtcggcggctaccacggcaagtggatcagcgccgagcaggcgcagacggtgaccatctcgcgcaagggcttcgccaaggtcgggggcacgctcggcgccggcatgctgatcccgatcggctcgaagacctgcgcgctgggcgaggtcgcccaggtcgtgcagtatctggccggcgagtccgccggccagtgcggcccgtgccggctcggtctgcccgacctggcccgcgcggtcaccctggtgtcactcggcggttccgcgctggagcaggtccggcaggcggccggcctggtgaagggccggggtgcgtgcagccacccggacggcacgtcccggttcgcgctgtccgcgctcgaggtgttccagaaggacgtggaggcgcacgccaacggcgagggctgcggcaagcaggtccgcggcatcctcccgctgccgtacacggccgagaagggcgcccggaagctggccctggactggtcccgctgtgacgggcacggcctgtgctcggcggtcgccccggagatcatccggctggaccacaacggcttcccggcgtttccgcagacgccgctgccgccgtggctggaggacggcgcccgtaaggcggtcaacgtctgcccggcgctggccctgcgtctgatcgacccggccaccgcggcgcattgatccacccgctcgccggcggtccgtcccggaccgccggcccgcacccttcgaagggaccgaggccgatgagcacccggcgtgccctgctgacgcttccgttcgcgatgctggccgccggctgcgccgcggcgccggaggcggcgaccccggcggccgcggccggtcgagggtccgggtcagccgcggccccggccgtccccgacacactgcgattcagcggtacgacgctggacggcacgaagttcgacgccgcccagttggcgggccggcccgccgtcctgtggttctgggcgccgtggtgcgccacctgtgccagcgaggcccagtccgtcgccgacttccacgacgagtacgccgggcgtctcaccttcctcggcatcgccggtctgggcaccgcgaaggccatgcgccagttcgtcgccgacctggacgtcggcaaggtcacccacctgaacgacccgtccggcacgatctggtcgaagttcggcatcgcccagcagagcacctacgtcctgctggacgccgccggaaagatcgtcacccggggttacctcgacgacctgcagctcaccgccgccctcaagaagctggccggctgaggagagccggtcagccgacctcgatcaggtgggtgcggccggccgcgtcccgctccacccgcacccgggtgaccagaccgggcgcgagccgcaccggcagcgccggcccgccgcccgcctggatcgagtgcgacccgggcgggagggccagcgtgagccgtttcccggcccggacccgccctttcgccgcgccgtccacggtgatcgggacggcgcgggcgagggtggccagtgagcgggacggcccctcgacgaccagggtggcgacgacggtcaccgggtcaccaggtggtcggcggggtgtgcgggctgtagacggtctcctcggccggcatcagcacccagaggaccgggtagatcaggatctggctgcccgggatcaggaacaggatcagcacgaacagcaggcgggcgagccacgggtcgaggccgaagcggcgccccagccccgcgcagacgccgcccagcatgcggccgtcccgcgggcggaccaggccctgccgggccatcgtgtcgtgcacggagttcatcacgcctcccaaggcgattaggtgatgccaccagagtgctacccgggtacgacactttccatccggcaccgcccggatccgaccctgatccccggcctcagggtcgaccctcgcggaaccgggcaccgggcctgcgtggtgtcgccccatgccgatacagtgctgcgggcgggaacctggggggcgcgagaacgatggtcgacgacacggtgccgggcgaacggacgcaaccgttgcgtccgcacgatccgcgcacgcttggcgactacgagttgctcggccgtctcggcgagggcggcatgggcaccgtctacctgggccgcagggcgggcagtgagatcctggtcgcggtcaaggtggtccgcctcgacctggcgcacgacgacgagttccgccgccggttccgcagcgaggtggagcgggcccggcaggtgccgccgttctgcaccgccgaggtgctcgacgccgaccccgaccacgagcagccctacctggtcgtcgagttcgtcgacgggcccaccctggccgacgtggtcgagcgccgcggcccgctgacctcggccaacctgcacagcgtcgcgatcggggtggccaccgcgctgaccgcgatccacggcgccggcgtgatccaccgcgacctgaagccgcgcaacgtgctgctcgccccgggcacccccaaggtgatcgacttcgggatcgcccgggccatgtcggccaccagcggcaacacccgccccgaccagatggtcggcaccgtggcgtacatggcgcccgagcggttcaacaccgactccgacaccccgatgctcaccccggccgccgacgtgttcgcctggggcagcgtggtcacctacgccggtaccggcaagaccccgttctccgccgactcgccgaccgcgaccgccgcccgcatcctcacccagccgccccggctgcacggtctcaccggcccgctgcgcgacctggtggcccactcgctggagaaggatccggccaaccggcccagcgcccgcgagctgctcgacctgctgatctccggtgaccgcccggcggccaccgcggccgccctggccgaccagcccgacctgcgcgccgccgcggtcgaggcgcaggccgtcaccgggtacgcgttgccgtcggcgaccgtcacgccgctgcccggtccggccctggacatcccgcccggcctggtcggctacagcgagaactcgatcgtcacggtgccgatcgagcagacccgggacaccacggggaccggcgcgccggccgcccgcccgcgccgccgggtgctgccggtcctgctcgggctgctgaccgtgctggtgatcgccggtggcctggcgttcaccggggtgctgctgcgcgaccacttcgccggccgctccgacgcggcggccggcccgtcgccggtccccgagtccgggtcgaccggcgccgcgcctcgctacgcggacgcgctggccaccgagggcctgtggcaccccaccgtgcaggacgacgagcaggccagctgcgcgttcgccaaggcggccctggtcgcgcggcgcgagaccacggggacctaccggtgccgtgggccgaaggacgtgctcaccgacgccacggtggaggtcggcgtccggctcgacacccggtacagctgcgccgccgtctggttccgcttcgacgacaagctcggcggctaccagctgcgcgtctgcgagagggacgtctatctcagcgagcaccgcgacgatgtgatcacggccccccggacgctgccgctgacccggccgatcgccctgtacgccacgccggtccggatcggcctgcggatccagggcaacgcggtcgagatcagccaggacgacacggtgatcggcacactcccgctgaagaacgccacgctcacccacggccgcgtggtgctcggcgtcttcaacgacccggcggcgcccaaggccggcccctacgaggtcgcgttcagcgacgtcaagatctggggctgaccaccctcgcggggccacgcgcggcgccgggccggcgccgcgcacccctagctagctaggccgcgctgaccgccctggccaccgccctgcccgcgctggccaccaccctgcccgcgctgcccacctggaccgccgcccggcccgcgctgttcgcgctgtccgccgccgccctgaccaccgcggtcctcgcgcggcggacggttccggtggggctcgtcggagagccgcatggtcagtgagatccgcttgcgcaccgggtcgacctcgaggacgcggaccttgaccacgtcaccggacttgaccacctcgcgcgggtcctgcacgaacttctcggacagcgccgagacgtgcaccagcccgtcctggtggacgccgatgtcgacgaacgcgccgaacgccgccacgttggtgacctggccctccaggatcatgccgggcttcaggtcggcgatcttctcgaccccctcggcgaaggtcgccgtggtgaaggccgggcgcgggtcccgacccggtttctccagctccttgaggatgtcggtgatcgtcggcaggccgaccgtgtcggtgacgaacttgtccggccggatgcccttgagcagcgggctgttgccgatcagcgtcttgacgtcggagccggcgtccgcggcgatcgtgcggaccagcgggtacgactcggggtgcacgctggagaagtccagcgggtcctcgccgtcccggatccgcaggaagccggcgcactgctcgaacgccttcgggccgagccgcgccaccttcttgatctcgttgcggttcttgaacgggccgttctggtcgcggtgcagcacgatgttctcggccaggccggcggtgatcccggagacccgggtgagcagcggcgcggacgcggtgttcacgtcgacgccgacaccgttcacacagtcctcgaccaccgcgtccagcgagcgggccagcttgacctcggagatgtcgtgctggtactgcccgacgccgatcgacttcgggtcgatcttgacaagctcggcgagcgggtcctgcaggcggcgggcgatcgacaccgccccgcgcagcgacacgtcgaggccgggcagttcctgcgacgcgtacgccgacgccgagtagaccgacgcgcccgcctcggagacgacgaccttggtcagcttcgcgtccgggtgtctcctgatcagctcggtggcgagcttgtcggtctcccgggaggcggtgccgttgccgatcgcgatcagctcgacgttgtgcttgctggccagcgcggccagcttgtggatcgactcgtcccacctgttctgcgggacgtgcggatagatcacggcggtgtcgacgcactttccggtcgcgtcgaccacggccaccttcaccccggtgcggaagcccgggtccaggcccatcgtggcgcgggtgccggccggagcggccagcagcaggtcgcgcaggttcgccgcgaagacccggacggcctcgtcctcggccgcctcgcgcagccggacccgcaggtcggcgccgaggtggatgaggatccgggtgcgccacgcccagcgcaccgtgtcgatcagccacttgtcgccggcgcgaccctggttgctgatcccgttgcgcccggcgatccggccctcgaagtagccctcgtcctcctccgggtgcggctccatggtgaggtcgaggacctcctccttctcgccgcgcagcatggccaggatgcggtgcgagggcagcttggcgtacggctcggcgaagtcgaagtagtcggcgaacttcgccccgtcggtctgcttgccgtcgcggaccttggcgaccagccggccccgggtccacatctgctcgcgaagctcgccgatcaggtcggcgtcctcggcgaaccgctcgatcaggatggcccgggcgccgtccagggcggcctgcccgtcggcgacccccttctcggcgtccacgaaggcctcagcggccgctttcgggtcgacggtggggtcacccagcaaaccgaccgccaggggctccaggccggcctcacgggcgatctgggccttcgtccggcgcttcggcttgaacgggaggtagatgtcctccagccgggccttcgtgtcggcctccaggatctgccgctccagcgcgtcgtccagcttgccctgcgagcggatcgactccagcaccgcggcccgccggtcctccagctcccgcaggtagcccaggcgctcctccagggtgcgcagctgcgcgtcgtcgagggtgccggtcacctccttgcggtaccgggcgatgaacgggacggtggcgccgccgtcgagcagctcgaccgcggcggtgacctgcccttcgcggaccccgagctcggaggcaatgcgctgatggatcgctgtcgtcacgtcgacgattgttaccgaggccgccgcggcttgtcgcgccgccccgcacacccggcggtagatgatcacccgtagggcttttccgacgcgcccgcgcgatgtctggctcccgggtgaaccgcccggccgggtgcaccgccacgacctgcggaaacgcccgggcgatcggggtcttccgagcggaggtgcacgtttactagagacaacccttcccgggctttggcactcttgcaccatgacgcttgctgtccgggcggtcgccgccactgatcagggcctggtccggtccaacaacgaagactcggttttcgtcggaaatcgcctcttcgtggtcgcggacggcatgggcggtttgcccgccggtgagctggcgagcgacatcctggtgcaggtgctcggcggggtcgatcagaaacccgacaccggggagccgctgcaggacctgatcgaggcgctgcaggtcgccaacaagcagatcgagaagtcggtcgccgaggacgacgcccgcgacggcatgggcaccacggtgaccgcgctgctgctctccggcgaccggctggccgctctcaacgtcggcgactcccgctgctacctgctgcgcgacggcgacttccagcagctcacccgcgacgacacgtacgtgcaggcgctcgtcgaccagggcgtgctcaccccggacgacgcccgccgccacccgcagcgcgccctggtcacccaggccgtgcagggcggcccgttccgcccggccggccggatgatcccggcccgggtcggcgaccgctacctgctgtgcagcgacggcctctccgactacgtcgaggacgcggtgatcgcccagaccctgcgggacaacgcggaccgccgcacctgcgccgccgagctggtcaaccgcaccctggagaacggcgccccggacaacgtcacggtcatcgtcgccgacgtcatcgaggtctgagacgccgcggcgcgcctcgcgcggctcccgctccgcgccttcgggtgcggggcgcgggaccgctcgaagctccccacggccccgggcggcggcgcgctgcccggcccgtcgcccgtccggtccggcacgcatccgcaccctccgcaacccctgccggcttcgcggaaccgacggcgccgacggtatccttctgcggatgctgttggcgacggagcggttgatcctgcggaggttccgggcggcggacgcggcggcgttcgcggagtaccggtcggacccggacgtggcgcggtatcagtcgtgggacgccccgttcccgctgaacaaggccgatgtggcggtccgcaacttcgcggccagctcccccgaccagcccggctggttccagtacgcgatcgagcacacctcggagcgggtgctgatcggcgacgtcgcggtccgcctgcacgacaacctgcggcaggcggagatcggcttcacgctggccaccgcgtaccagaagatggggtatgccaccgaggcggtcagcgccgtcctggaccggctgttccgcctgcagggcctgcaccgggtgatgggggagtgcgacgcccgcaacgtcgcctcggccgccctgatggaacgtctcggcttcacccgcgagggcctgctgcggcagcagaccttcatcaagggcgaatggaccgacgacctgctgtacgggatcctcgccccggagtggctggcccgggagagtgtcgtacccctgtgatcggatcgccgccatggacatcgacggcttctggcgcctgatcgagcgcagcgcccccgagcccgaccgcgacgcctggctcaccggcacgctgcgcaagctggcccgggtgcacatcgaggatttcgagatcctgctgcaggagtgccgtgaccggatcgacaacgccgccacctgggccgccgcctacgtcgtctacgacgggcactgttccggcgacagtttccggtatttccagtgctggctgatcgggcagggccgggcggcgttcgagcgggtcgccgccgccccggacgcgctggcgacgctcccggcgatccagcggctggccgggcgcaccttccgggcgtgggacgacgacgagtggccggaccgggaggctctggccggcgtcgccgcgggggcctatccggacgactccctggaggacgtcctggcggagcgcggcttccggcgccgggagtagatccacgtgctcctggtgagggacgggccgggcccgcccctcaccgaggtcagtggtcgagcttgagccagagggcgcccagtggcggcacccgcagggcggccgagtggtcgaaaccgtgccacgggatgtcctcggcctcgaccgcgcccatgttgccgacgcccgagccgccgtacagctcgctgtcggtgttgatcgcctcggtccagcgcccggcccggggcagtccgatgcggtagttctcgtgcgggacggcggcgaagttgacgatgcacgccatcgggtcgccgttcggggcgaagcggaggaacgagaacgtgttgtgctgcgagtcgtcgctggtgatccagcggaagccggacgccgaggtgtcctgggtccagaccgcgggagtctcccggtagacccggttcaggtcggtgatcaggcctttgacgccgccgaactgcgggtcgtcgagcagtccccagtccaggccgcgttcctcgctccactcccgcaggtcacccatctcggcgcccatgaacagcaactgcttgccggtgaaggcccacatgaagccgagcagggcccgggtgttggcgagcttctgccacaggtcgccgggcatcttgccggtgagtgagcccttgccgtgcaccacctcgtcatggctgatcggcaggatgtagttctcgctccaggcgtacacggtggcgaaggtcatctggtggtggtgccactgccggtggatcggctccttcgtcatgtaggcgagggtgtcgttcatccagcccatgttccacttgaagccgaagccgaggccgccgaggtgggtggggcgggtgaccccgggccacgcggtggactcctcggcgatcgtcatcacgccggggtggtgcttgtagacggtcgcgttcatctcctgcaggaagctgatcgcgtccaggttctcccggccaccgtactggttgggggtccactcgccgtccttgcgcgagtagtcgaggtagagcatcgaggcgaccgcgtcgacccgcaggccgtcggcgtggaactcctcgcaccagtacagagcgttggcgaccaggaagttgcggacctccttgcggccgaagtcgaagacgtacgtaccccagtcggggtgttcgccgcgccgccagtcgccgtgctcgtacagcggggtgccgtcgaagcgggccagcgcccattcgtccttcgggaagtgcgccggtacccagtccaggatcacgccgatcccggcctggtgcagcttgtcgaccagatgccggaattcgtcgggattgccgaaccgggaggtgggcgcgaaatatccggtcacctggtagccccaggagccgccgaacgggtgctccatcaccggcatcagctcgacgtgcgtgaagcccgtctcgacgacgtagtcgacgagctgatcggcgagctcgagataggtgagcccgggccgccacgagcccaggtgcacctcgtagcagctgatcggctcctgatgccaggccttcgacgcccgggagcgcatccacgactcgtcgtgccactcgtacgacgactggaacaccaccgaggcggtcgccggaggcacctcggtgtgctgcgcgagcgggtcggcgtgctcgcgccacaccccgtcccgtccgaggatcttgtacttgtacttggtgccgatgtgcgcgttcggcacgtacagctcccacaccccgctggagcccagcgaccgcatcggccacccgtcgaacggcccccagccggcgaagtcgccgatcacctggacaccgcgtgcgccgggcgcccacaccgcgaaggcgacgccggcgccgcgcggctgcgcgccgagcacccgccacagcttctcgtgccgaccctcaccgatcaggtgcaggtcgagttcgcccagggtgggcaggtgccggtacgggtcgtcgcactgcgtcccgtcgatgtcgagccggtagtcggtgacggtgcccggcagttcggccgcgaagatcccgtccgggtggaccagggtcgtctcgtaccgctggtcgtcgtgcagcaccgcgacgttcgtcgcacccttgcgcagggtccgcacgacggtgtgcccgccggccgggtgcgcgccgaggacggcgtgcgggtcgtgtgtgtcgccggcgatcacggcgttcatggcgcgctcgtcggcggccaggcgagaggtggtgtgcccgatcatcttcgcttcctcttcgaaatccgtggtcagccggccagccgggcgatggagcggagggggatccgcagccatccggggcggtgccgtgcctcgtatgcggcctcgtagaccgccttgtccaactcgtaggccgcgagcagtgcgccctcggcccgcgggtcgagcccggcggcgtgcgcgtacccgtcgcagaacgccgcccggttgcggtccacccactcgcgggcgcgggccgccaggtgctcgtcgtcctcctggtcgaccagcagctggtaggccgcgtactcgtaggagcgcagcaccccggccacgtcccgcagcggggagtcgggcagccggcgttcgtccagcggctgaccgggctcgccctcgaagtcgatcagcagccacgcctccggggtccgcagcacctggcccaggtgcaggtcgccgtgtacccgctggacggtcacctgatgcccggtgagtgcctcgaacttcgcggtgatcgccggcacgtactgctgcagctcggggaccgcgttggcggcggtccgcagccgggccagcaccgcgtccaccgggaacggcgacggcccggagccgagctgctcggccagggtcaggtggaccgaggcgaccgcctcgccgagccggtacgactcgccctggaagtcgccgcccacctcgtcggcggccatctcggcgtcggcgaacaggtcacgggccgacgcggtcgccatcgcccagccctcggcggaattggcggcgtacgcggtgaccatcccgagcgagcactgccccgcgtcgtcggtcgtctcgaacgaccccagcaggcgcgcgacgtgcgggttctccgcccggccgagcacccggttcagctcgatgtccgggttgatcccgcaggtgacccggcggaacaccttgaggatcgcgtcctgctcgaagatcacgctggtgttgctctgctcggcgtcgaacacccggggccacttgtccagcggcagctcgaccccgggctccttctcgaaggtcaggtcggcgaccggttcggagcggtcgaccagccccagcaggtagcgcgcggcgtccggggagtagagcgcgtcgtacgccacccggccctgctcgtcggtgccgatggtggccaccgcgctgtactccggcagcagctcggcgccgcgggcgatgagcacctggtaccgctcggaactgccgtcggtgtacgacacgtcgagcaggaccagctccagttcctcgcccagcggggtgctggacgcctccttgagcgaggccagcacccggctgcgtcccgcgtaccagcgctgtttcggcaaccactcggtatagggcagcgtcattgcttctcctccgacccgcacaactggaaccagtagaagccgtggcccggaagggtcaggaggtacggcagctgcccgatccgcgggaagttcacgtggccggtcagctccaccggggtgtacccgttccagtgctgcaggttcagctcgatcggctgcgggaaccgggacaggttgttgacgcacagcaccacgtcgtcgccgaactcgcgcaggaacgccagcaccgaggggttcgagccgcccagctcccggaacgtgccgacggcgaacgcctcgtgccggcggcgcaccgccagcatggtccgggtccagttcaacagcgaggtggcgctgtcgcgctgagcttccacgttgaccgcctggtacccgtacaccgggtcctggttgaccggcaggtagagccggccgggggtggcggtggagaagccggcgttgcggtccggggtccactgcatcggggtgcgcacgccgtcgcggtcgccgagccagatgttgtcgcccatcccgatctcgtcgccgtagtacagcaccggcgacccgggcagcgacagcagtagggcggtgaacagctcgatctggttccggtcgttctccagcagcggggccagccgccgccggatgccgacgttcgccttcatccgcgggtccttggcgtactccgcgtacatgtagtcgcgttcctcgtcggtgaccatctcgagggtcagctcgtcgtggttacgcaggaagatgccccactgacagttctccgggatggccggggtctgcgccaggatctccgagatcgggaagcgcgactcgcggcgcaccgccatgaagatccgcggcatcagcgggaagtggaacgccatgtggcactcgtcgccaccggacttcgcgtcgccgaagtactccaccacgtcggccggccactggttcgcctcggccagcagcacccggccggggaactcgtcgtcgatcaccttgcggcagtgcttgaggaaggcgtgggtctgcgacaggttctcgcagttggtcccctcctcctcgaacaggtacggcacggcgtccagccggaacccgtcgatgcccaggtccagccagaaccggagcacgtcgagcatggcctcctgcacggccgggttctcgtagttgaggtccggctggtgggagaagaaccggtgccagtagaactgccgccggaccgggtcgaacgtccagttcgactcctcggtgtcgacgaagatgatccgcgcgtccttgtacttctcgctggtgtcgttccagacgtagaagtcgccgtacggcccgtccgggtcgtgccgggacgcctggaaccacgggtgcgagtcggacgtgtggttcatgaccaggtcggtgatcacccggatgccgcgcttgtgcgccgcgtcgagcagcgccacgaagtcgtcgaccgtgccgaactcgggcagcaccttgtagaagtcgcggatgtcgtacccgccgtcgcgcagcggcgagtcgtagaacgggggcagccagaggcagtccacgccgagccactgcaggtagtccaggcgctcgatcaggccgcgcaggtcgccgccgccgtccgagcccgagtcgtagaacgcccggaccagcacctcgtagaagaccgcgcgttgaaaccacgtgcggtcggccgggagcgcccgggcatggccgaagtcgtccgcggacgggtgctcgaccatcccgtcctcggtgtgacttccctctgccggatcatgctcgctcgtcaagtccatcggtgtccccttaccccgcctgcaccacgaaaatgtgcgccggctcgacataggggtcgatccggaccgcgttgtactgcccccactcgtacgtcgcaccgctgatctgatcgaccacagtgaacttctcgtgccagtccttcccgagggccggcatgtcgagagtggtgttgccccactgcacgttggcagagtcgaacgagacgatcaccagcacggtgttgccggtgtcggcgtcgcgcttggagaagcacagcagcgcgccgttgtcgatctcgtggaagcgcagattgcggagccagtgcagggcggggttctgctcgcggatccggttcagcttggtcaggtagggggcgagggaccggccggcccgctcggccgcggcgtagtcgcgcggcttcagctcgaacttctcgttgtcgatgtactcctccgagccgggccggggcacgtgctcgaacagctcgtacccggagtacatgccccaggacggcgtgagcatcgacgccagcaccgcgcggatcttgaacatcggcggaccgccgtgctgcagcgactcgtgcaggatgtccggcgtgttgggccagaagttgggccgcatccagtcgatcgaggtgagcagctgctccatgtactcgcgcatctcctgcgcggtggtgcgccaggtgaagtacgtgtacgactgggtgaagccgatcttgccgagcccgttcatcatcgccggccgggtgaacgcctcggccaggaacagcacgtccgggtgcgactccttgaccttggggatcagccactgccagaagttgaccgccttggtgtgcgggttgtcgacccggaagatccgcacgccggcgttcacccagtgcatcaccacgcggtagacctcatcgcgcagcgtgcggtagtcgttgtcccagttgatcgggtagatgtcctggtacttcttggggggattctcggcgtacgcgatggtgccgtccgccttggtggtgaagaactccgggtgctcggacacccaggggtggtccggagccgcctgcagggccaggtcgagcgcgacctccatgcccagctcctcggccctctcccggaaggcgatgaagtcctccagcgtgccgagctcggggtggatcgcgtcgtgcccaccctcctcggacccgatcgcccacggcgagccgacgtcgaccggacgggcgaccagcgtgttgttccgccccttgcggttgatcctgccgatcgggtggatcggcggcaggtacacgacgttgaagcccatctcggcgatggccgggagccgcagcgcggccgtccggaaggtgccgtgcctgatgggcgtcgcgtccggcccgatctcggctccctccgagcgcgggaagaactcgtaccacgccgagtacagcgcccgctggcgatccacccagatggcgaacgaccgggtcgtggtcaccaggtgccgcaccgggttgtgccagagcagctcctccaggtcgagccccggggtgacccgggagaacagcgaccgctgctcgtcacgcagcgcggcggacgcggcccggacccgctcctcgtgctcggccggcacgatcttggtggccagatccaggatgtcggcgccctcggccaggtcgttggccaggtcctcggccccctgcccggcgccgatcttcttcaccacggcgtcgcgccacgtccggtacgggtcgtcgaacgcctcgatcgtgaacgtccaccgcccgacctggtcggggcggatcgcggcgtgccactggtccaggcccggcgtgccgggtgtcatccgggtgaacgcctgcggctggccgtccgggccgcgccataccacattcacacccagcgcgtggtgaccttcgcgataggacaccgcggaaaccggtaccagttcaccgaccaccgccttcgcggggtagcggccaccggacacagccggcgtcacgtcttcgatggggaagcgaccggtcatgatctccaccgtagtcagaggggctcagtaggacccggcgaccggaaaaaccaccgcggccgtcctatgacttctccggagtggaggttgttaaacggccgatcgccggtgccgtaaacctaccggagtccccccatggttccgcatccatatggggccgcgcgccgctggaaaacacgacaagttcaccttcgcgcaacaggcgccggtcgcggctcacccgcagcgatggatcggcgccggcccgcaggatccttgccggtacgccgggcgcaccccgccgcgctcagcgcgagcgctcgggtgtgcctcggttgccgtgcgttgccatcgaggaaccctgctcaagagcgggggccggacagccgagcaataccctcgacgccgccgaacaccggctgcgccttagaggaggagaacgaccgtgtccggtccgtccaccgcactgtccccggtgatcgccgccagcacccactggctggcccgcgcttaccccggcggggagtcgaacacggtcgcgcacacgctctccgaactgcaggcccggcaggccgtgacggtcgccgcctggctgcgctacccgaccgagatcgacgcggcgctggtcgcgatcgccgggccgggcgggtcggcgatcctcgactggaaggccggcagcgagccggacgacgagttcgccgagggcgagggctggcgcacctgggtcgacgaggtcgtggtcagctgggcggcctgcctgctcgccgacccggccctggcccgccgcggcgtcgacgcggtgatcgccgcgatcccgatcccggagccccggccgcgcccgcacgcccgccgcacgggcggcctgcccagcgagttccgtcgcctcctgcagcccgacgcccgtgaccgcgaggccgccaccctgctgcgccaccccgacctgctggagcccatcgccgccatgcaccgcgacacgctgctgtacctgctcgacgctgagccggctggcctcgctccgctcggcggggatcgcgccgcctgacgtcgttgtcgagggcaccgaaatcgacctcggcttcgcctagccgatttcggcaccctcgacaacgaccggcgcgatccgtgctgggccttgttgaagcagagccctggaccgaccctcttcgctcggcgtgctggggtgttcccccgacgcccgccggacagcgcgcccgaccccctggcgaagagggtggaaaccgcacggccggcaccccgccttgtcctcctgggggtgccggccgtgcggcctttcgtcagttgtcggcgaggcgggcggggaagccgccggtggcgatcgggccccacccgtccacggtgatacggatcaggcatttgccctggtcacgcatggcctggcgatactcgtcccagttcgggtgctcgccggagatgcagcggaaatactccaccagcggctccaccgcgtcgggcaggtcgatcacctcggcggtcccgtcgacctggacccacggcccgttccactcgtcggagagcacgcagacggagacccgcgggtcccggcgcaggttggccaccttggcccgctccggatagctggagatgacgatccggccctgctcgtcgacgccgcacgtgttcggcgaggactgcggacggccgtccctgcggaccgtcatcaggatcgcgtggtgccgcggccgcaggaacgcgaccagctcctcccgactgacccggtcgttcgtcgcgatcgtgcgggccatcagtgccgatcctccgcgtcggaggccggccggccggcgttgaccgtgtgcggttcggcgcccggcgcgccggcgtgcaccgggatcgagcccgggtgctgcccgccgggcccggccgcggcctgctcggcggagaccgcggcgccgatgatgccggcgttgttcagcagggtggcggcgaccaccggggtgcgcacctcgagcagcgggaagtacttgtcggctttcttgctgacgccgccgccgatgatgaacagccgcggggagagcagcatctcgacgtgccgcagatacttgctgacccggtgggcgtacttctcccagctcatgtcctcagcctcgcggacccggtcggaggcgagcagctcggcgtccttgccgtcgatctccaggtggcccagctcggtgttgggcagcagcaccccgtcgaggaacatcgcggtgccgatcccggtgcccagcgtcaccatcatgatcaagccggaccggtcacgcccggcaccgaaggccacctcggccacgcccgccgcgtccgcgtcgttgagcacggtgaccggcctgcccagccgttcgccgaacagccgcgccgccggggcgtcgatccaggacttgtgcacgttggccgcggtgcgggtgacgccgtcgacgaccacgccggggaaggtcactccgatgctgtcgaagccgtcgaacttggccgccacctcggcgaccgcgtccaccacgctgtccacgtcggccggctgcggggtcggcacgcggaaccgctcgtcgagcagctcgccgcgcgtggtgtcgaccggggcgcctttcacgccggagccgccgatgtcgatgccgaggatggtcatccgttgtcccgtcttcctgctgatcactcgtccgtgctgtttaccacgcggtacgacctcgcatcctgcccactcgccgcggccggcatgccacacgggcggatgaattcgctccgtagttcccgcattcacgcaatgtcactcatactttcggctaggcagggctaagcttctcggctagcgttgcatttcagaacggtcgccgcgtgcgggcacggctctctgcccgctgatggaggaccacatgacaacagctccgcttcatattcatcgatccgctgggaccgcctccgccgacccggcgcccgaggccaccgccaccgagctgctcgacgcgatggccgtgctgccggtcggccagcgacgctgccgggtccgtgaccgggcgatcgaggcctggctgccgctggcccgccacctggccaaccgctacgccggccgcggcgaaccgaccgacgacctgatccagaccgccaccgtcggcctgatcaaggccgtcgacaaattcgacccggagcgcggcgtcgacttcgccggctacgccatccccaccatcatcggggagatcaagcgccacttccgcgaccgcacctggtcggtccgcgtcccgcgccggctgcaggagctccgcctcgccatcaccgaggccaacagcacgctcacccacgcgctgggccgctcgccgaccgtcccggacatcgcggtgcacctcggcatcagcgaggaggacgtgctggagggcctggagggcgcccgcgcctacaacgccacctcgctgtccaccccgatcaacgcggacggcaccaccgagctgggcgacacgctgggcgccgaggaccacgagtacgagctggccgagacccgggtggcgctcgggccggcgctggccctgctggacgagcgcgagcagcggatcctgacgctgcgcttctacggcaacctgacccagtcgcagatcgccgaccagatcggcatctcccagatgcacgtctcccgcctgctcaccaaggcgctggcgaaactgcgcacccagctggccgccgagacgctgtaggacccaccctccctgccggaagaaaagaagcggtgcggctcacccgcaccgcttctttctctgcccggccggttacgaagcgccgctggcctgccagttcagtcgcaccagcagcgccttggccgcgtcggccacctcggcgtcggcgagtaccgcgtactgcgcggcctgcaggctgctgcgcgaggtgaagtcgcgccgcccgccggtcgcggcgtgcgcgatcgccccgaagacggcgccccagaccgcgccgatcagcaccgtggtcaggatgaccgagaaccagttcgcgttgccgaacagcccgaacagcaccccgatgaacagcccgaaccaggcgccgctggccgcgccggccagtgccgcgcggccggtggtgagccggcccagcaccgtttcgaccaggcgcaggtcggtgccgatgatcgaggtccgctcgaccgggaatctgttgtcggagaggtggtccacggcttgctgggcctgcgcgtactccggataggtgccgaccacgacggtggggccggcgtgcctcggatcgtcgagggatgcccgggcggggacctgcggcacgccggccgggccggccgggacctcgggtgagggggtggtcatgacttgcctccctgctgcggttcgggcagcgggtcaccggcggtgagccgcacccagaagtagaaggtgccggcgacggcggccacgatgcccgccacaccggtcagaaaggcgaaccggccggacaccagatccggcatgacgcgctcggacaccgccacggtggccaggccgaacaggcaggcggcggtgccgatcgcggcgaccagcgccagcggcagggtggccacccgggccggcgcgatcgacggccgggccccgccgatccggcgcagccggatcacccaggtgatcagcgcaccgcaggccagcacgatgaacagggcggcgatggtgtcgctgggccggtgccactcggcccagacggtggccaccgcgacgatcgtcacgtaggccgcgccgagcagccccatcgccccgcgcagcgcccgcggaaacgccaggatcagcacgaacgccaccgaggcggcggccgcggtgtgtccgctggggaacgagttcggcatcccggtaccgtccaggtcgggccgggacaggtggctcttgagctgctggacggccaggttcgcggcgatcaccagcagggtcgcgccgatcgacaggtcgaagcgtcgccggaccgcgcccaccgcgaccgccaccagacagaccacgccgagcacggcgagctgggtggcctccagggtgcggctgagcaccagggtgacctgttcgtggtggacatcgccgccgcgcagcgcggcggtgtcgatgctctggcccaacccggtccggatgaaccccaggtagaccaggtatccgccggcggccgcgaggatcgccaccaccagcggtgatatcgaatgccaggtgctcggtgtgtcgccggtgacgtttgtccgccgtgtcgcgaccgccgtcatcgctctctccctgtgtcccccagccgatggtggacgcacctttgcccagtctccctgatttccaagcgcgtcaccgatcacaggagcaaccgatccgcacccggacgcgctcttgccgcgcaacggccgggtcggacctttgttcagacgccgatcggaacaaaggggatgttttcatgaggcacagctcccgacgactgctcaccggcgccctgctggtgcttgccgccggggccgggctcggcgtgacccccggggtcgccaacgccgccggggtcaccgccaccgtcgatgtcaacagtcagctgaaggtccgggccaagccgtcgctggcctcggggatcatgggcaccctgcacgacgggcagaaggtctcggtggcctgcgcggtcaccgggcagagcgtgcgcggcaagctgcgcaccacggccgtctgggacaggctgaccagcggctactacgtctcagacgcgtacctgacgacggtggggaaggtgccctcctgcgtcgccgcgccggtcggcgagaaggtcaagaccaaacccgggacctccggtggtacgaccgctccggcggtcgtgacggccagggtgaagaccgcggacggtgcggtgaacgtccggaccacgccgtcgtcgcagggcgtgtcggtgcggaaggtggccgacggtgccaccgtgcaactggtctgcgcggtgccgggatccagtgtcaaggggacggtgcgcaccaccaaccagtgggatcagctgaccgacggacggtacctctcgcacgcgtacgtcgtctccgccgatctgaaggtctgcgccgcctcggcggccaccgcgccggccacgcccagcatgacgcaggcgcagttcatcgcggccgcggtgaccggggcgcaggccgggtggcggcagttcggcgtaccgccgtcggtcaccatcgcccaggcgatcctcgagtccggctggggtaagagcggcctggccgcggtcgaccgcaactacttcggcatcaagtgccagaagggctcgtacgggtccatcgccagcggctgtcacgtgtacgcgacgaccgagtgtgacaaggccggtaaatgctttccgacctcggacgcgttccgcacctacgcgtcgatggccgactcgttccgcgaccacggaagcttcctgcgggtgaacagccggtacgcgccggccttcgcctacacccgggacgccaacaacttcatctggcaggtgtggaaggccgggtacgccaccgacccgaactactacaccaaggtgaccggcctgatgaccgcgttcaacctgtaccggtacgacacctggaaatagcaagtcggtccgatccgggcgttttgcggcatacgctgcatgtggtggagggacggagtcgatacacaggtccggcgctcgcgaccgcggtcgtgctcgccggactgctgtgcactctgctgaccgtcgccgggctgcgcggcgcccagcgggacaacgcccgccacgtgatggaccagcgcacccggatggccctgtccgcggtcaccgccgagaccgaccgttaccgcgatctgctggaaaccctggccgccgggctcgccgaccaacccgccctcacctgggcgggtttcgaccaggcgagcgcgccgctggccggggccgggctcaagggcgcggccgcgatcgccttcgtggccccggtcgccaccgccggggtggccgcggccgagcggagctggcgggcccggggggcctccggcctgaccctgcggccggccgccggtctcggcgagcactacttcacggtcttcagccgcaacctgaacgaggacgagacggtcaccgcgaccggcggcaccgacgtggccggcgtgccgcagccggccgccgccctgcagaccgcccggcaaaccgggagcaccgccgtctccgacacctacgtcctgctccgcgaccgcgacattccggccgcccagcggcagcattcgttcgtcttcgccgcgccgatctggacccgggccaacaacccggtattccgcggctgggtggtgctcggcctgcgcggcggcgacttcctcgccggcgtgctcagcacggtcagccagcagcagctcgacggcagcctggtcgcggtcaacagcgacggcacccgggccgaggtggccaccctgcgcgtgcccggcaagcgcgacctgcgccgcgagcaggcggtcccggtcgccgaccacgtctgggagctgaccctgcaggccgactcggcccggctgcccggcgccggcggtcacctgccgggcaccgtgctggccggcggcctgctgctcagcatcctgctggccggcctggtccaggtgttggccggcggccggtaccgggcccggctgcgggtcgaacaggccaccaccgagctgcgcgcggccgaggcggagagccgccggcaggccgggctgctcggagcgatcatgacgaccatcggcgacggggtcagcgtgatcgacgccgacggccggatgctgctggagaatccggcggcccggcggctgaccggggtgaccgagtcgagcgacgcaccggagcggtggcagcggcactacggcgtgtaccggccggaccgggtcaccccactcccggtcgacgagatgccgctgatccgggcgctgcacggcgagacggtcgagggcgcggagctgttcgtgcgcaacccgggccggccggacggggtgctgctcggggtcgacgcccggccgctggacccgagcgccggcctgcgcggtgcggtcgcggtctaccgggacgtcaccggcctgcgccgctacgaacaggacctgtcgatcttcgcgggcgtggtggcgcacgacctgagggcgccgctggcgatcgtccgcgggcactgcgagctggccctcgacgacccgggtgacgaggccgaggtgcgttcctcgctgggccggatcatccgctcggtggaccggatggacgcgctgatcgagacgctgctggcgtacagcaccgcccgggacgcgccgctcaacgtggtcgacctggatctggaaccgctggtccgcgaggtgctgcaggagcgggccgcgagcctgcgcggccagggcggcgccgagccgcggtggtcggtcggcccgctgccgtcggtccgggccgatccggcgatgctccggcacgtgctggacaacctggtcggcaacgcgttcaagtacgtccgtccgggcgcggtgccgtgcgccgacgtcaccgccgggcccgccgcggtgcccggctggacccggatcgaggtgtccgacgccgggatcggcatcccggagccggagaaggcccgggtcttcgagtcgttccaccgggcgcagggctcggccgggtacgccggcaccgggctcggcctggccatctgccaccgggtcgtggttcggcacggcggcgagatcggggtcgaggacaaccccggtggtggcacccgcttctacttcaccctgccgctgtcaccggcggccacccgagaggagaacgacatgagacacatcccggccgaacccgccgagcaggaggacgcgagggtacgcgcggcgctggaccgcgccctggccgagcgggccgccgtcctctagctagctagcccgtcggcgcacgacccggccgccgcccggctgcgcgccccggtgcccgaccatcagcaccaggactagccggtacggggaccggcgccgtcggtggccggctgcgggatcagcgcggcgaccagggccagcaactgggccggcacgaacggcttgagcagtgtcgccgccgcgcccgcgtcgctggcccgctcgtcgccgggcagcagcgacccgctggccaccaccaccgggatgtgccgcagatcgtcgtccgccttgatcgcccggcacaggtcgagtccggtcatctgcggcatgtccacatcggtgaccaccaggtccggacggtgttccttgatcgcggccagcgcggcaacgccgtcggccgccacgacgacccggtgcccggcccgctccagggaacgcttgagcacgtaacggatgtcgtcgtggtcctctgcgacaacgatcaccctcgacctcgattcggttatcggtatcccgtcatccgggataccgattcagtacggccgggggaaacggggtgacaccgtccattccggccggtgggaaagggctgaacgggtgagtcgtccaccttgaccggtcgtaccgtcatccgcacagtgaggcgcgtgaatccagatcatcaggacggcgagctgatcccgggcgacgacgccccgccccgcaggcgcggctggttcggccggcggcccggctggcagaaggcgctgatcctgatcgccgtgctggtggtggtcctcaccggcggggtggccggcggcggcctgctgctggtcgaccactacaccggcaaggtcgaccgggccgcgctgctgccctcgccgccggccgacgaggccgcgcagagccggcagaactggcagaacggcgcgctcaacctgctgctgctcggctccgactcgcgggccgccgaaccgggggagaagagcccgatcggcgagcgctcggacaccatcatgctggtgcacatcaaccgggcccgggaccacgccacgatcgtctccatcccgcgggacagctacgtcgacgtgccggccggcggtacctggaagggcggcaagaacaagatcaacgccgcgttcgcgttcggcggggcggcgctgaccgccaccacggtccgcaagctcaccggcattccgctggacggcgcgatgatcgccaacttcgcgagcatccgcgacctggtcgacgcggtcggcggggtcgacgtctgcgtgccctacgacgtcaagtccaccttctccgaccgggagtggaagccgggttgccacgacatgaccggggacatcgccgaggagttcatgcggcagcgctacaacgtgcccggcggcgacttcggccggatccacaaccagcagctggtcgtccaggccgtgatcagcaaggtggccaggaacaacctgctctacaagccgctggccctcgacgagctgctcggcatcgcggccgactcgctcaccgtcgatgagaacctcgacctgcgcgacctggtcctcgcggtgcgcgacatccggccgcgcaacatcgcctacgccaccgtgccgtacacctcggcgaacctgaagacgccggccggcgccgcggtgcagttggacaccggggcggccgccgagatgttcgcggccgtcgggaacgacaccatcgatcagtggctggcggaccacccgcagcacttcccgggaagctgacgcccggcggagggcggtgttaatcaccaggcgatcgcgccgggatgcgcctatccttggcgcgccatgtcgacatcgccctccgctccgccggccgagctccgcagccggatcacccagctcctgccccgtgacgaacaccggatcgggcgccgtctcgaggggacccggcggatccgcgacgacgccgccaagtccgccgcgctcgccgagatcaccgccgaggtcgagcgggccgaggcgcgcctggcgagccgggccgccaccgtgcccccgattacctatccggaggcgctgccggtcagcgcccgtaaggacgacatcgccgccgcgatccgcgaccaccaggtcgtggtggtggccggcgagaccggctccggcaagaccacccagattccgaagatctgcctggagctgggccggggcgtgcgcggccagatcgggcacacccagccgcgccggatcgcggcccgcacggtcgccgagcggatcgccgaggagctggaccggccgctcggcgccacggtcggctacaaggtgcgcttcaccgaccaggccggcgaggacacgctggtcaaggtgatgaccgacggcatcctgctggccgagatccagaccgaccggatgctgcgccgctacgacacgctgatcatcgacgaggcgcacgagcgcagcctcaacatcgacttcatcctcggttacctgcgcgacctgctgcccaagcggcccgacctcaagctgatcatcacctcggcgacgatcgagacgcagcgcttcgcggagcacttcgccgacgccgccggccagccggccccggtgatcgaggtctccgggcgcacctacccggtcgaggtccgctaccgcccgctgatcaccacccaggtgatcgacgatgacgagatccgtgaggagccgatcgatcagatcgagggcatcgccgccgccgtcgacgaactgcccgccgacggcgacatcctggtgttcctgtccggcgagcgggagatccgcgacaccgccgacgcgctcaccaggaaggacctgcgcaacaccgaggtcgtcccgctgtacggccggctcagcgccgccgagcagcaccgggtgttcgagcggcacaccggccggcggatcgtgctggccaccaacgtcgccgagacgtcgctgaccgtgcccggcatccgctacgtgatcgaccccggcaccgcccggatcagccggtactccagccggctcaaggtgcagcggctgccgatcgaggcggtctcgcaggccagcgccaaccagcgcaagggccgctgcggccgcacgtcggacggcatctgcatccggctgtactcggaggaggacttcgacggccggccggagttcaccgagccggagatcctgcgcaccaacctggcctcggtcatcctgcagatgaccaacctgggcctcggcgacctggcgaaattcccgttcatcgacccaccggacaagcggaacatcaccgacggcatcaagctgctcgaggagctcggcgccctgcaggaccgcaagctcaccccgatcggccgccagctggcccagctgccggtcgacccgcggctggcccgcatggtgatcgaggcggaccgccaggagtgcgtggccgaggtgatggtgatcgcggcggcgctgtcgatccaggacccgcgcgagcggccggccgacaggcagcagcaggccgacgagaagcacagccggttcaccgacaaggaatcggacttcttcacctacctcaacctgtggcgctatctgcggcagaagcagcaggagctgtccggcaaccagttccgccggctctgccgcgccgaattcctcaactatctgcgcgtgcgggaatggcaggacatctacgcacagctgcgccaggtcgtccgtacgctcgagctgaatttccgcgaggactgggagtcgggagtcgcgccgcagccggtgcacaccgcgctcctcgcgggtctgctgagccacatcggcctgaaagacaccgacaagcgcgaatatctcggggcgcgtggcgcgaaattcgcgatcttccccggatcggcgctgttcaagcggcagccgcgctggctgatgtcggccgagctggtggagaccagccggctgtgggcccgggtaaacgcccgaatcgagccggagtgggccgagaaactcgccccgcacctggtgaaacactcctacagcgagccgcactgggatcggaagatgggcgccgtgatggcgttcgagaaggtcaccctctacggtctgccgatcattccgcggcgccgggtcggctacggaaagatcgatccggtggtggcccgggacctgttcatccggcacgcgctggtcgagggcgactgggacacgcaccacaagttcttcgaggcgaaccggcaattgctgcgccggatcaccgagctggagaatcgtgcccggcggcgtgacatcgcggtcgacgacgaggcggtccacgcgctgtacgacgcgcgcatcccggccgacatcgtctcctcccggcacttcgacggctggtggaagaaggcccgccacgagaacccggatctgctcaccttcacccgggaagacctcgtcaacgccgggcgggacaccgtcgaccccaacgccttcccggacgcgtggctggccggtggcgtcaaactcccgctcctctacgagttcgagccgaactcgcatgccgacggcgtgaccgtccgggtgccgctcgacctgatcaacaagatcgacgcggacgacttcggctggtccgtgcccggcttccgcaaggacgtggtgatcgcgctgatccgggccctgcccaaggcgctgcgcaccagcttcgtcccggtgccggactgggccgacgcggtcctcgaccgggtgccggtgcgccgcggcccgctgcccgacgcgatcgcgggcgagttgcgccggctcagcggcaccatcgtgccccgcgacgcgtggcgccccgaccaggtccccgaccacctgcggatgaacttccggatcgtgaacgaggcgggcgaggtggtcgccgaaggccgcgacctggacgtgctgcggcgcgccctggcgcccaaggtgcaggccaccatctcccgggcggccggcaacctcgaacgcaccggcatcaccaccaacgacttcggggcgatcccgcaccgggtcgcccagcagcgcggcggctatgcggtgaccgtctggccggccctggtcgacgagggcgccagcgtcggcgtcaaggtcttcgagaccgaggccgagcagcgggtcgcgatgcgcgccggcacccggcggctgctgcttctcacgctgccgccggccgcccggttcctgcagggccgcctggacaaccgggccaaactcgaactgtcccgggccaacccgtaccggtcgatcgccgacctgctcgacgactgcgcgggcgccgcggtggaccggctggtcgccgacgccggcgggccggtctggtcgtcggtcgagttcgcctcgctgcgcgacaccgtccgcgaggacctggtcgacgcggtcgccaacgtggtcacccaggtgcaggcggtgctctccacggcgtacgacgtcgatcagcggatcaggcagctcaaggaccccgggctgctgcccgcgctggccgacatccggcagcagctcaagggcctggtgtacccgggcttcgtgaccgagaccggctggcgccagctgcaccacctgccgcgctacctcaaggcgatcgcccaccggatggaccggctgggcggcggcgtcggccgggaccgtcagctgaccacgcagatccacgagatcgagacggagtaccgcgagctgctcgccgaggcgccgcccggcgggccggccgcggaggggctgcgggagatccggtggatgctcgaggagctgcgggtgagcttcttcgcgcagtccctcggcaccgcctatcccgtctctgacaagcggatattcaaggcgatggacgcgctgccgctgtagtcggttgcagcttggtgcggctgcggtgccgttcggtcacgcccctgtcgtggccgtccggcgccgtttaggtttctcggcatgacgaaccgtgccgctgcctccgcccccgtctccgccgtctccgccgccgtctacctcgacgagatgatggcccgggtcggcgtcgacggtctcgccgcggcgttcgccgcccccggtctgctggccaccctcgaccagcacgcggccgccgttcgggaggcggtgctgggcgcgggccggatgctggacgcggacgggctcgcggcgtacgcccgcagcatcgccgccgcggcggtccgggccggccgtccgctgcccgcccccggcgcggccccgaccacggtggccggttggagcgccgccgcctggccgatggtgcggatggtcgcggtctgcctgatcgcggagtccgccggtctcctctgagtgccggagtaaacccatacgatctacttagtcgggtttattacccaccaaaccggttttatcgggcatcttcgtccccatgaggatgttcaaactctccgcactcgcactgctgacggttccggtcatggccgcccccgcggccgccgcccccgtggtcgacccgccgtccaccctggtcgcccgctacaacttcgacggcggcgccaccgccggcaagatcagcgacctgtccggcaaaggctccagcctcaccgtccgcggcgaggacaacggcacggtcgcgatcaacaccgagggcgccggccggtacgcgtccttccccgccgtctgctccggcaccggctcctgcgcccgcgccctgctcgaagcccccaactcgcccgacctgaacccgggcgtacgcaccttccactgggccgccagcatccgcgtcacccaggcccagctgcacggcaaagccaacatcatgcagaagggcctggccggcgccgacagtgtctggaagatgcagctcaccggcaagaacggccgcgccgtctgcatcatgaccggcaagggcagcgcgcagaccttcagcgccatctcctccaagcccctcgccgacggcacctggcacaaggtcgtctgcgagcgcacccccaccagcctcggcatctcggtcgacggcacggcgggctcgcacgtcaccatcccggcgaccctctcggtggacaacaccatgccgttgcggatcggcggcccgaacttcggcgccaccagcgacatgtaccacggccagctcgacgacgtgtacatccaggtcggctgaggccgcccactcccgtagcgggccggcctccgggccggcccgcgtcgtctccctcgctgcggtcttcctcgctgcggtctctctcgccgcggcctccctttcgccgcctctgccccgcgccggtcccaccctccgctcctactgcgtacctcggcgtctccctcgccgtttgttgcggctggcgccgccgccccctcggtccggtccgattcccgtcgccgcacccttcgctcgtcgcgttccgcgccgcccccttccggttcgggtcacaaacccgctggtcaaggctcgctggcggcttctggttgcggcctttcccggtgtccctcgcttgccggtacgccgtgagcacacccgtcgtgccggaccccgaataatcggtggcgcccgcgtgggaagcggcataggttgaccgcatgctgtgatgcacaccaggcaaaccccgggtcttcggcatgcgggtgcgagcgttcgggctccagcgttcgggctcagcccttgcgctctgcgccggtcgtcccccgtgtccgattctgatgccgcgaggctcgatggccggcaccgctcgatggccggcaccgctcgatggccggcaccgctccatgacggcaccgctccatgacggcaccgttcgatcaggcggtcctgctcggtcgagcggtcccgcgctcgatgcccgcgccgcgtcggtttcacgtctcagccggatcctgaacggtgccgactcagcggcccgtcggttctgtgcgcggcgccggcacgctgactgtccgggtttgcccttcgcgctggtcctcggccattctgccggggcgggcctccgggtgtgcattgtggaattctcgatgatgattctgcgagggcgcacccgtgaattccgccgccacggaaaccggccgtcaccggctttccgcccgaaccccggaacgggccccaaaccgtattccctggaggtggcaatatgcctgcccagcctttctccgtccatcccgacctggcggaactcgcccgccgggacattgccgcggccctgacccgcccggcggtcgaggacggttccggcgcccagcccgacccggccgacgccgcgcaccacggcgcccgcgacacccggcaggccgcccgccgcagctcggaccgcgcccacgcgggccgagcggccggtgccggcggtggccgcagctacgccttccgccgcagctgaccgatcccgatcacggctcaccggctgttgatcaccacgagacccggccgcctccgcgcggccgggtttccgcatttcccgaccgatggcctggcggggtctgcccacgccgcgttcgccggttcgggtgtccggtgtggtgccggttcggcggccaggggtgcggttgtgctcacgcgaaaagcggtgagcaatccgggatgcccgttctggtgggtcggtggtactggtgatgtgcgcgacgcttggccggtcgtgatcgggcgggtggggaacgtcgcgacggggcgggtcgccgggcggtcgtgatcgggcgggtggggaacgtcgcgacggggcgggtggccgggcggtcgtgatcgggcgggtggggaacgccgggaccgggcgggtggccgggcggtcgtgatcgggcgggtggggaacgccgggaccgggcgggtggccgcaccgccgggagcgggtgagtggcgggtcagggggtggagaggtcggccagggccaggtcgagggttttcgtggcggtggggaagtcgatcagctggtcgcggacgatatgcaggccggcccgcagggcggtcaccgggacgaggcgggcggtgaggacgtcggcggtccacgaggtgaagtcgcggaagatctgaggttcgtcgatgtagagcgaggcggccaggaagtcggcgatgtggccgaagtcctcggcggtggcttcgcgctggcggtcgtcgtagtcgcggacctcggggtggacggcggccaggcgctgcatcgcggtgtcgatcagctgggggcgggagcggaccaggtgggtgtactcctcgtcgccgaggtgctcgctcaggctgctcgggacgaaaccgccggaagccgggaagtccggggccggcgggggtggccagtcggtggccaggcggacgacggcctcctcggcggaggtggcccaggcgtcggcgccgagccgggcggcccagcgggcctgcgggccgaaaccccggccgccggcgatgaccgggacgccggccgcgcggcaggccgtgatggcggcgtgggcgcgggggagccgggtggggatcatgcagctcagggccaccgcatcggggccggtctggtgcaggtgggtgatcaggtgcgggccggggacgctggcgccgaggaagtcgacccgccagccatccagggagagcagctcggccaggatccgggcgggcaggccgtgccactcaccgtccacgcaggccaccgtgatccggccgcgatacgtggaagcaccgccccggtgcgcgtgagcagcatcgcggcccggccccgcggtgccgcggtccgcgggagaggcaccggcatccggccccgcgacgccgcgagcggcagaggggtcgcggtcggcggtggcgggggagcggtcagcggcggagaggtcgcggtcggcggtcgtggaggagcggcgcggtgaggggcgcaggtgggcggcgacggcggcgaggacacgttcgttgacggcggtggcggcgtgttcgcgggcgaccgaccactcgttggccgcccacagctcgccgacccgggcctgcgtgccgccgatcaggtcgaccatgatccgctggggtcggacgccgttgtcgagcagggtgagggcgagctcgacggcggcgtactcgtcgccgtcgccgaccaggcgcagatactcgtcgtggaggtccgggtcgtcgagcgagtggacggtgaccgaagtgatcatctcagtgccgggaccgttcggtgacgcggtgggtggtgcgcgaccggccgagggtgcggtgggcggtcatgatcggggccggacccttcggtcggggcggcgggcggcggtgagatagggggactggttcggggcgcgcagggtggcgccgccgtcgcggaggctcagcggcgggcgggggtgcgcgcggacggcgagcatggcgatgtcgtcgccggggccgccgcggacccagtcggagaccagttggcgcaggcgttccagggtgaccgcgccgggcaggccggcgcagtcgctcagggcgcggcgcaggcgggtctcgccgaactgctcgtcgccggccgggccgccgcgggcctcggtcaggccgtcgctgtagagcaggcagagttcgccggggccgagctcggcggtggccgggcggaccgtcgtctccggcatcacgccgatcagggtgccgccggtcggcacctcctcgacccggccgtcggcgcgcagcaccagcggcggtggatggccgccgctggccagttcgagacagatccggccgtggtcgacgcgggtcaccgagccgaccaccagggtgacgaaccgctgccggcgaccggagtcggtgagcgccctgttcagcacgcgcagcatcgtctccgggccggcgtgcatcagccgcagcgcgcgcagcgtctggcggaccttgccggtcagcaccgcggcctccggcccggtgccgcacacgtcgccgagcgccacgaccgtgtccgtgctgcccgggaccgggccgaacacctcgtagaagtcgccgccgacgagcatcgtctcgcgagccgcctgataggacccggccagctcgaagccgtcgatctcgggcagctccggcggcagcaggtcggcctgcagcaccgcggcggtcgccacctgctcctgatagagggcggcggcggcgagcgcggcgccggcccgggccgcgtacacccgggccagggcctcctcctccgggctgaacgtgccggtgcgggccaggatcagcgctccggccggctcggcgttgccgggcagcgggatgaccagcagggcgccgagcgggccgagcgcggccgggaacagccagcccggcgtctgcgccgggtccagccagcgactcgggatcggcgggaagccgtcgatcacctcgcccagcccgggcacctcggccaggttgcgttcgggcagcgtgccctcctcgaccgggtggccgggcagcgcccggctccaggcgctctgccgcttgtccggcgggaggatgaccacggccgcgtcggccaggtgcgcggcggccagctcgaccgtggtgcgccggaccagccgggagtgcagcgaggcggagagccggcggccggcgtcggccaggaacgcggcccgggcgcgctcggcctccagcgcggcggtgcggtcgcgctcggcggcgccgtcggccagaaaccacacgtaatgctcgtcacccacggcgcggcgacgaccgtaccagcaatgctgtcgatcctcggaccggaacgactcgccgccggcggccgcggccgcggccagctccggcagcggcgccgcggtcagcggatcgcccggctgcaggccgggcagcagcgcgcgggccgcctcgttgaccagcacgacggtgtccccggcggcggcgcagagcagcatcgcctcgctcgccgcgtcgaggaccgcgcgcagcagcccgggaggcgccgcggtggccggcatgcgggccgacatcgtgcctcctcgctgagggtcgtggtcgtccccagcctacggggtcgatggggggatggggttgatcagcgtttcacatcgacgatcaccggggcgtggtcggacgggcccttgcccttgcgtgcctcgcggtccaccacggcatccgtgaccgcggcggccagttcggcgctcgcgtacacgtggtcgatgcgcatgcccttgttctgatggaacatcccggcgcggtaatcccaataggtgaacgggtggtcacccttcatggcgcgggccggcacgtcggtgagcccgaggtcgcgcagcgcggcgatggcggcccgctccggctcggtcacgtgggtggagccggcgaacaccgacggatcccacacgtcgtcgtcggtgggcgccacgttgaagtcgccggccacgatcagcgggccggccgccaggtcgtcggcgagggcgagccgcagcgcccgcagccactggagtttgtaggtgtagtgcgggtcgtccggggtgcggccgttcggcacgtacaccgacatgaaccggatgccgtcgcagaccgcgctgatcgcgcgggcctccgggccgggatagccgggctcgccggggaagccgcggcggacctcgtccaggccgatccgggagagcagggcgacgccgttccagcggccctgaccgtacgccgccgtccggtatcccagctcgcggacctcggcggccgggaagccgtcctcggcgaccttggtctcctgcaggccgaccacgtcgggggcggcggtctccagccactccagcaggcgggggaggcgggctttcaccgagttgacgttccaggtcgcgaagcgcatcagcccattatcggcgcagcccgccgcgggtcgccgcgaacagcgccgcggcgagtccgcccgcgagcgcgacgagcatggcagccagcccggccgaagtcatcagcgaataatgccggacttggctacgcggcaccagggggactgacaggttggtcggtggacgggacgactcacgggggcgtgcgatgcgggtggaagtcatgccggtggtgccggacgagctgcgggacggtgcctgggacttctaccgcgagtcgttcgccgacctggcggtgctggcggtccaccggcacgtgctgcaccgcgaggagttcgacgagctgatggccgacgagcgggcgcccaagtacgtcgcgtacgacgccgaggaccgggtggccgggatggcctcgatgaccaccgagctggacgcggtctcgctgatctcaccggactacttccggcatcactggccggagctgtacgcgcagcggcggatcttctacgtgctgttcgtcggcgcggcccggggcgcccgcggggccggcgtcttcgtcgcgctgctgcgccggttgtacgcgccgatcgccgaggtcgacggcaaggtgttcgtggacatctgcacctacaacgaggagcgtcaccagctgccccggatgatcggggtgatcctcggccgggtctccggcaaggcggtgccgacccggctggacgcccagtcgttctggctctacgagttcccgggcaacggtctcccggagtccgtctagtcgtcgatccggcggtggcgcccggagctggtcaccgtggccaccggcagcggcacctcgggcagcgccgcggtcaggtgccagcgttcggcgaactcggcggccggcaccgccttgccccacagccagccctgcccgttcaccacaccgacgtggtagagggcttcgcgctgcaacggggtctcgacaccctcggcgatgacgctcaggcccagcgcgtggctcatcgccaccaccgcccggacgatctcgtcatcctgatcgttcttgccgagaccggtgacgaaggagcggtcgatcttgacgccggtgaccgggaaacggcgcaggtagcccagcgccgagaagcccgtgccgaagtcgtcgaccagcagtttcaggcccagctggcgcagctcgtgcaggactctggcggtgacactggagccgtccaccatcaccgactcggtcatctccagggcgacacagtgcgccggtacgccgtaccggaacagttcgccggagaccaccagcggcagctcgggttcgctcagctggcgcggtgacacgttcaccgacaggtagaagctctccgacacgaccccctgcgagcgccacacgccaagctgacgcagcgcctcgttacggacgaacgtgccgatctgcgagatcatcccggagtcctcggcgatcgggatgaacagcatcggcgggatcgacccgcgttccgggtgctcccagcggatcagcgcctcggcgccgaccggcatcccggtctccaggcgcacgatcggctggtacaccacgtacagctgatcgtcggtgagcgcctggcgcagcgcgacctccagctcgatccgctcgcgcacctggtcgtgcatcgaggtgtcgaagatcgtggaccggcccggcccatcgcccttggcccggtacatcgcggtgtccgcgtcgcgcatcagcgcctcggcggtgaccgcggagcgcaccgcgtcgccgaccgagtgcgcgatgccgatcgacgcactgatcaccacctcggtgtcgcggaccggcagcgaccgggcgaagcagccgcggatgtcgtcgaccagccgcagcgcgccggccttgtcgccgacgaaggcgagcaggaactcgtcgccgccgacccgggccaccggcacggcctccggcaccgcggcgcgcagccgccggcccacctcgatcaccagctggtcaccggtgtcgtgaccccacgagtcgttgacccacttgaagccgtccaggtcgagcatgtagacccagacccgctgctgaccgcccaccccggtgaccaggcgttcgatctcggcggagatggactgccggttgggcagcccggtcagcggatcgtgcgtggcctggtgctcggagtgcagctgggcggccacctgggcgtgcaccgcggacatcgcccgggccagcagcagcaccaccatcagcgcgccggccacggcgatcagcagccggtgcgaggcggcgctggtcccggtggtcagcagcagcgcgaacggcaggaacagcgcgggcagcagcaccgcgagccgctgccaggaccaggcctgtacgggcagccggtcggcccggctcatctcggtcaccgacgggtgcagggcggccacccccaaagccgtgtaggccagcacgtacggcacgttgagcagcggcgacgcgtagatgtggccgttgaccccgacgatggcgtacgcggtgtcgccgaggaacagcccgatcatcatgaccagcagcgccaccatgctgatcggccacgtcttggtggtgaacgccaggttgatcaccagcagtgccagcacgatgtcgaacagcgggtaggtgccctggatgatggagagcagcgcgggccggccggcgatcgccgcggccggcgcggccagcagcagcgtgctggtcagtccggcggccaggcagacgatcaggccgtccagcacggcgtgccgctccaggctctgccgggcccgcagcagcatgaacaggaaggcgccgagcagcagatagccgctgaagctggcggcgtcggcgagcagcggcagcggcatcggctggttggtgaccgtgggccggatcagcagtccgaccaggaagagggtggcggccagagccatcagcagccaggcgaccggcggctcggcgccccaccggcgggggccgacgaagcacgccgcgacggtcagcacgccgagcacgaccaggctcaccgaggccaggctcgacgacgaataggccgcgtagagggcggtagcgaggaccccgatgacggccatcaactgccattggcggcgggctatgccgggcgggagcaccgatagcaccgggcattcctcccgttttgccctaagacttagcttttgctcaccgtagcaacggttcgcgcctgccgtggacaaaaacggtcggacacccaccatggcgcagcaactcgtgcgccaccgaaccgaatcgggccgcgccgcccgccccgcgcggtcccagtgcgagcaacgcgacccgctgcgacaggcggaccagcgcgccggccgggtcgccggtcagcagccggcgctccggcgacggcaggtccgggagcccggccagcacccggtcgagcaccgcgtcgtcgtccccggccacctccagcggcaggccccggcgtaccgcctcggcggcggcgtgccgcagcgccagcaccgacgggccggagccgtccaccgcggccagcaccggaccggcggccggtcgggccccgcgcgccaccagcaccgggcaccaggcctgcgtcacggcctccagcagcgacgatgtcggcaggtcggtcgcgccgacgacgagcagcgccgcggtccggctgaaccggcgcagcacactcccggcggatccatccaccagttgaccccgcacgtccgccccgggtgtgcaacgctgggcggtggcgaccgcctcctcgacgacgtgggcggcggcgcgccgggcttccgcaccgtcccaggcgaaagcgtgcacgatcgacaactgagtgccgcgggagaccgcctcccgggcggccaggcgcacggcggacagaccgcccgcggtcccggcgacaccggccaccaccggcggttgattcgggatccgcatcgcccccggcctccgctcccgtaacgttctcgcaatataccgatctatatctatggtgcaacggtccttaggcactggtgaccaatgcctcaccgggtggccacctgatgacccattcaggttcagggtttacggtgaacggcaaaatctttgggacatctgccggtgaagtgagggaaatacatgacggatgtcaagctcgaccaccctggcggccaattgtcgatgggtgtgcgcgaggccgtcgacgggccgggcggcatcgacgtcagtgcgctgctgaaggagaccggttacgtcaccctggatcagggtttcgtcaacaccgcgtcgaccacgtcggcgatcacctacatcgacggtgatgccggcattctgcgttaccggggttacccgatcgagcagctggccgagaagtcgacgttcctcgaggtctcgtacctgctgatgaacggcgagctgcccaccgaggcgcagctgcgtgacttcgccgacaagatccgggtgcacaccctgctgcaggaggagatgcgcacgttcttctccggtttcccgcgggacgcgcacccgatggccgtgctctcctcggcggtcaccgcgctgtccaccttctaccaggacgcgctggacccgctcgacgacgagcaggtcgacatctccgcgatccggctgatggcgaaacttccgacgatcgccgcgtacatctacaagaagtccatcggccacccgctgccgtacccggacaactcgctcgactacgtcgagaacttcctgcgtctgaccttcggcctgccgaccgtcaactacgacgtcgaccccaaggtcgcgaagatcctcgacatgctgttcatcctgcacgccgaccacgagcagaactgctccacgtcgagtgtccggctggtcggctcctcgcaggcgaacctgttcgcctcgatctcggccgggatcagcgcgctgtccggcccgctgcacggtggcgccaacgccgccgtgctggagatgctggagcagatccgcaaggacggcggcgacgtcaactccttcgtcacgcgagtgaagaacaaggagaagggcgtcaagctgatgggcttcggccaccgggtctacaagaactacgacccgcgcgccgccatcgtgaagaaggccgcccaggagatgctctcgaccctggagacgccggacccgctgctggagatcgcgttccagctggaggagatcgcgctcaacgacgagtacttcgtctcccgcaagctgtacccgaacgtcgacttctacaccggcctgatctacaaggcgatgggcttcccgaccaagatgttcacggtgctgttcgccatcggacgtctgcccggctggatcgcccagtggcaggagatgatgcacgacccggccaacaagatcggtcgcccgcggcagatctacaccggttcgccggtccgcgacttcgtcccgatgtcgcagcgctgaacgcaccgaggtaatacggcacgtaccgagaggcgcgatccgtgccggcactggcggaaagacttttctgacgccccacttctccggtggggcgttttccggtctcgtacattccttgacggtcatataaccagggtggcatgctgggcgggtggacgtcatcggggccctcgccgaaccggcccgccgccgcatcgccgaggtgctgctcaccggcgacgccagcgtcggtgacctggtcgacgcgctgcggatgagccagcccgccgtctccaagcacctgcgggtcctgcgcgacgccggcgtcgtcaccgtccgcgcccatgcccagcagcgcatctaccacctggaggccggcccgttccggcagctcgacgcgtggctcacgccataccgcaggctctggagccggcatcgggacgccctcggcgaacaccttctcgaggaggagccatgaccggaccacagccgcaagcccgggtcgccgccgacggtgaccgctggacgttgatcctcatccgcgatctgccccagccgcccggcgaggtctgggacgcgctgaccgacccggagcgcctcgatcggtgggcgccgttcaccgcggaccgcccgctgaccgcgcccggccccgcgacgctgaccctggtcgacggcgacgagcggaccgcgctgcccgccgaaatcgtccgggtcgagccaccccacctgctggaatacacctggggtgaagacctgctgcgctgggagctcgccgcggccgcaggcgggacccgactgacgctgcggcacacgctgaccgatcgtgacatggatgcgatggtggctgccggctgggatctgtgcaccggggtgctgcggcggctgctcgacggcgagtcggtcagcgcgatccgcgggcggtcggcgatggaccacggctggcgcgacctgcgggaccgctacgccgaacagtttcggtcagattcgggatcctgatggcgtgcgccgcggcggatgacggaccgctgttcccggccacggcgatggtggcggagccggccggtcagctttcagggcggatcgccgcaccccaccatccgcgggcggtcaccggaacctcgatcagtagggtcggcgcatggccgtacagggattgcagcgcatcatcgtctccgttgccgacctcgaccgggcgctcgggttgtaccgggacgcgctcgggctcaccgtgaccgcgcagttcggcgagatcgcccggctggacgtgccgggcaccaccaccgaactcatgctccaccagcggccgccgacagccggactcgccggggtggcggccagcttccgggtcgacgacgtggacgcgaccaccgcggccgcggagaaggccggggcgacggtcgtggacgcgccggcggatcagccgtggggtgagcgccaggcggtcctcaccgaccctgatggacatgtgatctgcctggtcgctgtttgacgggcaggtccggggtgggaaagattggcgtccgagcggttgcggaggaacccggtgcgagtccgggacggtcccgccactgtgaccggggagcgacccgctgacgcgacagcacgccacggccctgcggccggtgcggccggcgcgcagggccgcggcacaccacggcttccgggccgaggtggcggcggcacaccacggcccgcgggctggaaggtgggcgggaaacggcgatccgggagtcaggagactccggccgctcgtgacagccgacgtgcgggcgtggacacccgccgggagggaacaccctgtgactactccgtacccgttctcggccgtggtcggcctggacgatctgcgcctcgcgctgctgctgacctcggtgtcgccggcggtgggcggcgtcctggtccgcggtgagaaggggaccgccaagagcaccgtggtccgggcgctggccgggctgctgccgccggtgacggtggtgcgcggctgccggttcgcctgcgaccccgccgcgcccgacccggactgtccggacgggccgcatcccgcggacacgccggccgggcaccgggcggcgacgctggtcgagctgccggtgggggcgaccgaggaccgggtggtcggcaccctcgacatccagcgcgcgctggccgacggggtgaaggcgtacgagccggggctgctcgccgccgcccaccggggcgtcctctacgtggacgaggtcaacctgctgccggaccacctggtggacctgctgctggacgcggccgcgatgggccgcgcgcacgtggagcgggacggggtctcggtcaagcacgcggcgcggttcctgctggtgggcacgatgaacccggaggagggcgagccgcggccgcagctggtggaccggttcgggctggtggtcacggtggcggcgccgcgggatgcgcggctgcgggccgaggtggtgcgccggcggctggcatacgagctggatccggccgggttcgcggcccgtttcgccgacgacgagcgggagtacgcggcccggatcgccgccgcgcgagccctcctgccgagcgtgaccctgccggacgcggagctcgaccggatcgcccggatctgcctcgcctacggggtggacgggatgcgcgcggacatcgtcgtggcccgctgcgcggtggcgatggccgcctggcacgggcgcgacgtggtcaccgccaccgacgtcgccgacgccgcccgcctggccctgccgcatcgccgccgcaccgatccgctcgacccgccgggcaccgacgaggagaagctcgatcaggccctggccgaggcggagcgtcaggctcaggacgaggcggggcgtcaggctcagcaggaagcggaacgtcaggcccgggaggacgacggcggccccgacggtgacgggccggacgacaccccggacggcggcccgcgcgacggcggcccggacgacgggggcccgggtccggacgggggtggtcccggtggcggtccggccggtgacccgccgcccggccccccgagcagcagcgcgccaccgaccgaggcgccggcatcggacggcgggtcaccggactagctagctagtcgtcgactgcgagtccgggccgatccggctggggctggcccgccggctggccgccgctctgggcgccgacgtcatgccgctcgacgagttggaggcggcgaccgcccggtcggcggagcgcggctaccgccacgccgcctgaccgcgggcgggcagggcagcgggcaggcgggatcgcggctaccgcgacaccgcccgagggcgggcacgcagggcacagggcagggcaggaccgcgacgcgggcatcgggccggcgcgcggcgggcacggctgacggcgtaccgggcaagcgcgggcagggaccgccgctgaccgcaaccgggcagcggcctcaaggaaccggggacagcgccgcgcagcggcggagaagggttggcaatgccgcaggggaaagtgaccaccgtgcccgacgacggcctgaccacgcgtcagcgtcgccgtcaggcggtcttcgccgtgcacaccgggccgggcaagggcaagtccacggccgccttcgggatggccctgcgcgcctggagcgccggctggccgatcggggtcttccagttcgtcaagtcgcagaagtggaaggtcggcgaggagaccgcgctcaaggccctcgacggcgtgaacggcaccccggtcacctggcacaagatgggcgagggctggtcctggatccagcgcgccgggaccgagagggatcacgccgcggaggcggccgaggggtgggcgcagatcaagcgggatctggccgccgaaacgtacaggttctacgtgctcgacgagttcacctacccgatgaagtggggctgggtcgacgtcgccgacgtggtcgcgacgctgaccgagcggcccggcacgcagcatgtggtgatcaccgggcgggacgcgcatcccgatctgattgaggcggccgacctggtcaccgagatgaccaagatcaagcatccgatggacgccgggcgcaagggacagcaggggatcgaatggtgacgattccccgggtggtgatcgccgcgcccgcctccgggcacgggaagaccaccgtggccaccgggctgctggccgcgttcgcccggcgcgggacgccggtggccccgttcaaggtcggtccggactacatcgatcccggctatcacagcctggcggccggccggccgggccgcaacctggacccggtgctggtcggcgaggagctgatcgggcccctgttcgcgcacggcgcgcggggcgccgacctggccgtggtcgagggcgtgatgggcctgtacgacggccgcaccggcgccggtgagaccgggtcgaccgcgcaggtcgccgcgctgctgcaggcgccggtgatcctggtggtggacgccgccgcgcagggccgctcgatcgccgcggtggtgcacggcttccgcagcttcggcacggtccggctggccggggtgatcctcaaccgggtcggctcggaccggcacgagcagatcctgcgggacgcctgcgaggaggtcggcacgccggtgctgggcgcgctgcgccgggccgacgcggtcgccgcgccgagccggcacctgggcctggtcccggccgccgagcgccgctagctagctaggtgcccagcccgagcggccgggtggccgagctggccggcacgcccagcgtggccgaggcggcggcgctgcgcgcggccggccccggtgcggtgctgatcctgcccaaacggatcttcggtggcgtcaccgtggcgatcgccggcccggtctagacgccgaccggccattcgtggaccgggatgttctcgtgcatgagcggcaggtagcgccgcatcatctcgtgcagcgcccgctgccgctccatcccctgcttctccagctcgtgcagtgtctccacctgccacgacgcgccgttctgctggcgcaggcagcgctgctcgatgatgcccatcagccggtcccgctgggccgtcgagaccccccaccggtccagcccgtcggccgcctgcggcagcagccggcgcagcaccagctcggtcaccggcaccgtgcccacgcccggccagaacacgctggcatcgatcccgtgccgcgcgcaggcgtggaagttctcctcggcggcccggaaactcagctgcgtccagaccggccgctccgcctcggccaggtgccgggccaggccgtagtagaacgccgcgttcgccatcgtgtcggccaccgtcggtccggccggcatcacccggttctccacccgcaggtgcgggcggccgccgaccacgtcgtagatcggccggttccaccggtagaccgtgccgttgtgcagcctcaactcgctgagcgccggggtgtcaccacgctccagcaggtcggccggatcgtcctcgtcgcagatcggcagcagcgccgggaagtaccggacattctcctcgaacaggtcgaagacgctggttatccagcgttccccgaaccatacccgcgggcggacaccctgtgcccggatctcctccgagcgggtgtcggtggcctgctcgaacagcgggatccgggtctcgcgccacagctcgcgcccgaacagcagcggcgagttcgcgcccagtgccacctggatcccggagatcacctgcgaggcgttccagtacgcggcgaactgcgccgggctgacctgcaggtggaactgggtgctggtgcaggccgcctcgggcgcgatcgtgtcggtggtgaccgccagccggtccaccccgtcgatccggatgtccaggtcctccccgcgggccgcgaagatctgctcgttgagcagcgcgtaccgcggattcgcggacagtgccgcgccggtcaggtgttcgcggcgcagggtcggcaggatcccgacggtgaccaggtgcacgcccaccgtgcgggccttgccctcggcgtggttgaggctggcccgcagccccttctccaggtcggcgatgtcgtcgccggccagccgccggggcggcaggttgatctcgatgttgaactggcccagttcggtctggaagtccgggtcggcgatcgcgccgagcacctcggcgttgcgcatcgccgggccggcctgcccatcgatcaggttgagctcgatctccatgccggtcatcggccgctcgaagtcgaaacgggcttcgcgcagcatcgtcgcgaacacgtccagactgcggcggaccttctgccggtaccggctccggtcctctcgggaaaactgtgtctgttcgactttctcgcccaccaggcaccaccttcgcaaggcgtcagcgacgagggagaacgggcatcgtcgcagcggtccccctggacccatgattaccgctgtcgatgcccgaaccccatcccgacgagcaaccttggcgggtgatggttaacgcagcgtcgaacatggacgccccggtacccgctagtaaggttttctacgccactgctcatcggggcctagcggaggatcgcggccatgatgatcccggccaccaccagaccggccgccgcctgcagcagcatcgccgggcccaggtgtgaccagcgggtcgggatgcgcggggtgagcggctgcatggtggtcaggttcaccacctgggtgagccgcaccggcagggtccggtcccgctgcggctcggtgcgcacctgcaccaggtcgccgcggtgcagcgcggactgcggcaactgcccgtgcatctcgatctcgtacgtctgccccagatcgtcgcgcaggcggaccggggtgaccaggaactccgggccgctgcgcagctcacgcaggctgcgccgggccggtttcatccgcagcagcgcggccaggagctgggcgatgccggcggtgaggaacaccgcgaccgccaatggccgccccacccgcacctcccgggtgtacgacggctggaagccgatgaaccggccggtgatgatcggactgacgtgccggaggatccgctcgcggtgcagctcggtgtcgtccatggggatcacctcctggatgttcctcaatgttacggacaggacttacccgagcaccgtgagtgaatcgtaaattcccgatcttcttctccttatcaatcggcaacgccctccgggccagaaaccgggcaattcccaccgggttgcggaaacccgcacgtcagggccacccgtcggggtgaactggacgaggagtcgcgcgaacctcggcgcggacggggggcggagaccagtggcaccgacgaactatgtcaaaccggatagtgtgctggcgcgcaccgcgcgtgacatgctcgccgcacacgccggtggtgaggggccgcgcgagggtctgacccgctgtcccgcctgcggcgaaccgctgccctgccgctccgggcaggccgccgccgaagtactcgccgccgccggactcgccgaggcgtccggcctggtcgcggccacccgggtcgcgttcgccccgccgcccgggcaacccgccttcctgccctcctggaccgcttcggaagaggttgcggatccgctcggctccggaccgattgccggtggtacgccgtcggcactcgcgccgtgggccgcggtcgccccgtcggccgacccgctcaccgatcccctccccggcgcctccgaaggcccgctgtccggtgcctctgcgggaccgctgtccggcgcctccgcgggaccgctgcccggcgcctccgctggacccctgtccggtgcctccgtcggaccgctgcccggcgcctccgctggtccgccggctggggacgggggggagtcggccggcgggccgctctcgacggagctgccgaggtgggccaccgaaccgaccggcacccacgagcggccctgggcgtccgcgggcggggaatcgtggaccgaatcccggctcggcggtcttccgcgcaccggcggcggccagtccggagccggcgcgggcggcaacgccgggccggccccggcggcaaccgggccgggggcgaactccggcccgggatttatttcgcagacatcgagcaatggtacgaatggtgcgccgagcgcgagtggcttgaccgtgtccggactcggctcggccgaaccgccacccggcggggaagcgacccccgaagccggtcggcacggccgcgacggcacccccggcgtgaacggcgcggcggccgacgcctccccgctgcgcgcctgggccaccggcgacgagccgtcccccgccgacggccggacctccagcggtcagccgtcgagcggtcagccgtcgagcggtcagccgtcgagcggtcagccgtcgagcggtcagccgtcgagcgctcagccgtcgagcggtcagcccttcgtcagtcggtcgccggagggccgcgcgccgggccgcggcgcgcactagctagctagtctcgtggccgccggccggagacggcgatgcggctctggatggtggccagcgcgcctggccacccgcggcgagcggctcggggagcggatcaggcagcccgctgcgggcgtggccggcagcggacagtgacccggagagggactcggccgctgcgctgcgggcctttctgcccacggagagcggctccggtaccgggccgcaggcgtggccgcccgcggagggtggtccggagagcggctcgggtagtggcttgcgggcgtggccgcccgcggaggatggtccggcgagcggctcgggcggtgggctgcgggcgtggccgtcggcggagagcggcgagacggctcaggacggcgggcagcgggcgtggcccgcgactgacggtacctcggcgaccggttcgggtagcgggctgcgggcctggccgccggtcggggagaccggcacgacggacttcggcacccccggctccgggccgggcgctggtgccggtgcaacgggatccggtgacatcggggtcgagccgtccggcggccgccccggttccggcttgacggggatgggtggtgcaggtgcttcgttggctgacagccctggttctgggctggctggtgcgcccggtaccggcgaaccgggatcgggcccggcggggctcggcggctggggcgcgtccgctgccgggctgggcggtcctggcgcgtctgcgctcggtgtctccgctccggggctgggcggtgtcggctcctccgtcgccgggccgggcgcgccgggctccggcgagggaggttctgcggcgtccggcggggttggcgcgggggcggccggtgggggactgcgagcctggcctccgccggagagtgtgcctggcggtgcgggctcgcccaccgggaacgcgaccgggtcggccgccgttcccggagtcggcggtgccgcgggcggagatcgcgcgtggccgccggccgcagccgtcgagaagccggtgtccggcgggctcaagccgtggccgccagccgacgacacgccgggtgatgcggccggttccggcctgagcgcgccgtcgggactcggcggcccggcgggaccgaccgggctcggtgcgggtaccggggtgaaccttccctcgctgtccgacgacgcagggaacgcgcccgccgcggcgatgaccggcacgccgccgtgggcgacctccgctccggcggactcgccggtgaaccccgcgtggccggcgcccggcaacccgggtggggacggcgtggccggcaccggcgtaccgccgatgacggccgtgcccggcgacaacggtgacggggcgccgccgccctgggccgtggctgcccccggtgcggtgcagcagccgacggcgccgccgcccgcgggctagctagctagtccgggtcttcagccgccggacatggggcaggcccgccccggcctccagccgtccgacatggggcagcacaaggcgccggccggtgcggctcagcgttccgggctgcaggcgccggacatggggcagcacaaggcgccggccggtgcggctcagcgttccgggctgcaggcgccggacatggggcagcacaacccgccggccgggcccgctcagcgttccgggctgcaggcccccgacatggggcaacacaatccgccggccgacggcgcggcgcgatccgggctgcagccgccggacatggggcagcacaaccgtccgggcgcgctccaggtcccggacatgggtcagacccgtcccgggctgcaggcaccggacatgggccagcacaccccgccggccgcagaccaggcggagccctcgggtgcgccgatggacgagaccagcgccccgtccggtctgccgggccgcgccggcgcccagccctcccgcggcgccggcccggcggaagacggcccggacgacccggccagcgcaccgagcggcttgccgcgccgctagcgcccctggctcgcgccgccgatcccggggctcccggcgccggtggcttccaggctcgcgtcgccggcggcggcgcggagccaccggcgtaccgccggcaatcgggcggtcagcggagggccggagtcagctgtgtccagaccaccttgccgtcgctgaccggcagcacgccccacgccgccgagagttcccggaccagccgtaacccgcggccgccggcgtcactgacgccggggtcgagcgagcgcggcaggcgccggctgccgtcgcggaccgccatcgtgatcgtgccgtcgcgcaggcccagggtgaagaccatggtggtgtgcgcgtgccggaccacgttggcgaccagttcggtggcgatcagcgccgcggtggcggcgaactcggtgcggtgccagcgggcgcaggcctggtcgaccaggtggcggacctggcggcaggcgtcggggacggggcgcaggcggatccgcaccgattccgggagtggttgccggccggcctcggcgagggcggccgcgcagtcggtggccatctcgacggcggcgcagtccggggcggcggccagcgcggcgcaggtgcccgggtcggcgccgcagacgacgatcggcacgttcgggaactccgcggtctggcagaccaccgagccgaacgtgccgagggcgagcgggtcggcgaccttcaatcggctcacgtcgagcagcagtttgaccggctggacggcgaggctgcggcggaccgccaggcccagtgcgtcaccggtgagccggtccagggtgccgctgaccgacaacaccgccaccgggaggtcctgctccggccggcagaccagctggctgggcatgcggatctccttcccttcaggtggtgacgggaggctgagacagcaggtgcccggccaccccggggggcaaacccactcccgggggcaatctcctgcgggcggtgcccgggagtccggcggatggacggcagcgaaataaagtaccgttgcgcgccatgggtgtgtcgcagcgaatgaagaaccgattccgcaagtttttgcagcgtcccggcacgactgtggacctcgggccgctgtcgaggcgcctggagccgatcgaggctcgcgaggaggcgctcaaggagctcgacgacgcggcgctgaccgacgcggctcgggaggccgccgatttcaccgaggtctgcgcggtgggccgggaggcggcccgccgggcgatcggccagcggccgtacgacgtgcagctgctcggcgcgatggcgctgctctccggccgggtcgccgagatggccaccggtgagggcaagacgctgaccgcgacgatcgccgcttacgggcacacccgcctcggcaacggtccggtgcacgtgctgaccgtcaacgactacctggccaagcgggacgccgagtggatggagccgatctacacgctgctcggcctgacggtcggctcggtcaccgaggcgatgaccccgcaggagcgccgcgaggcgtacgcgtgcgacgtcacctacgtgtcggtgtccgaggccggtttcgactacctgcgtgaccagctggtcaccgacgtggccgaccgggtgcagcgggagctggccaccgcgatcgtcgacgaggccgactcgatcctgatcgacgaggcccgggtgccgatggtgctggccggttccacctcgtcggagagcgacccggtgcacgaggccgccgagctggtccggacgctgcgggccggcaaggactacgaggtggccgaggacggccgcagcgtcgccttcaccgagtccggcctgaagaacgtcgaggagcagctcggcggcgtcgacctgtacgccgacgaccaggtcgcgacgctgtccgcggtgaacgtggcgctgcacgcgcacgccctgctgcgccgcgacgtggactacatcgtgcgcaacggcggggtcgaactgatcgacgagatgcgcggccgggtcgcccagcgtcgccgctggccggacgggttgcaggcggccgtcgaggccaaggaggggctgtccgccaccgccgagggcgaggtgctcaacaccatcacggtgcaggcgttcatcgcgctctaccgcaccgtctgcggcatgacggcgaccgcggtgcacgtcggcgagcagctgcgggagtatttcaagctcgaggtcgcggtggtcccgccgaacacgccgaacatccgcgaggacgacccggaccggatctactcggcgcacgacacccgggacgaggcgctggtcgaggagatcaagatcgcgcacgagaagggccggccggtgctgatcggcaccctggacgtgcaggcgtcggagacgctcgcggcccagctggccgaggccggggtgccgtgcagcgtgctgaacgcgaagaacgacgccgaggaggccgcgatcatcgcggaggccggcgccgtcggcgcggtcaccgtctccacccagatggccggccggggtgtcgacatccggctgggcggcagcgacgagaaggaccgcgaccgggtggtcgagctgggcggcctgtacgtgatcggcgcgggccggcacgacagccgccgggtcgacgaccagctgcgtggccgggccggtcggcagggtgacccgggcacctcggtgttcttcgtcagcctcgaggacgagctggtctcccgacacgccggcaacatcctgccggcctcgccgcggatggacatggacggcgtggtgcacgacccgcaggtggactatgcggtcgagcacgcccagcgggtcgccgagggtgtcaaccacgagatccaccgcaacacctggcggtacagcgtggtgatcgagcagcagcgactgctgctggccgagcggcgcgagcggctgctcacctccgaggtggcggcgatcatgctgctggagaggtcctcggagaaggccaaggagaccgacgaggacgtgctgtccgacgcggcccgggcgatcgcgctgttccacctggaccggctctgggccgaccacctggcgtacctgtccgaggtgcgcgagggcgtgcacctgcgggcgctgggcaagctggacccgctggacgagttccaccggtcggcggtgcccgccttccaggacctgctgaccaaggtcgaggagcggaccatcgagacgttcgaggaggtcgacctcaccgacggctgggagccggaccgcgcggagatcgtccggcccagtgcgacgtggacctacctggtgcacgacaacccgttcggctccgagctggaccggctgatcgccgcggtgggccgccggctcaccgcgggtggctgatttcacgcagatttttttcttcccgggggcgccgtgcttgtacggcgcccccggtcacgttccggcccagctcagacgcgtggcgttcggccatgcttaatatggctgacagaaagcgttaccggaatgcattggtgtgaccgggaacaatatggaacgtgtttctcacactgtggatggtgacttgacccgcaatacggatgaccggaattatcaggcccgcattacgcacagtgatcaatcgtattcgcttgccgcagcaaattctgggggtcccaaccaatgccggtcagcgcattgtcgccacgtgccgatcgtcgttccgccggtccgggtcgcggcccgggcaaccgtcgcaccgagccggcgctgaccgtgacgctcgcgatcccgctcaccggggacgccgtgtcgccgcaggcccaccggctgctcgccgcggtccgcgagctggtcgagatgagccggggcacggtgaccgtcgagtccgcgtcggcggccgccgagtccgagccggagccggttcccaccgggccggaggtgcggctgctcaccgggtcgcgccaggtcctgctggagggcgagccggtgccgctcacccgcctcgagttcgacctcctgctctacctcgccgagcggccgcgccgggtgttcagccgggcccagctgctggccggcgtgtggggttacgagcgggccggggagcgcacggtcgacgtgcacgtccgccggctgcggctcaagctgggcgccagcgtgcccgcggtgaccaccgtctacggagtgggctaccggctggccgacgacgcccggatcacgatcatgccgcacgattgaggccatgcgtgctcgtcccgtctcgttcaccgtcctgatcgacgatctcgccgatcggctggccggtcgggaatccgacagtaggatccgggtggccgtcgacggcgcggacgcggccgacccggcccgcctcgccgacgccctcgtcgacccgctgcgggtccgcgggcgcccggcggtccgcatcgacaccagggacttcctgcgcccggcctcggtccggctggagttcgggcgggccaatccggactcgttctacgccggttggttcgacgaggccgggctgatccgcgaggtgctcgacccggccggaccgggcggctccgggcgcatcgtcacccgcctctgggacgccgccgtcgaccgggccgcccgcgaaccgtaccgctcgctgccggacaatgccgtcgtgctggtcagcgggcccctgctgctgggttccgggctgcccttcgacttcaccgtccaccttgccgtctcgccggccgcgctggaccggcggaccacctcggacgaccggtggaccctcccggcctttgtccgatatgcggacgaggtggccccggaaacttttgcggatgtggtcgtccgtctcgatgatccccggcatcctgccctggtcacagcgttgggctgaccgggagggtgaccgccggcacacgacccgtgtgccgagtccgtggcggaactgaccactgacagttatgctccggttactttttcgcgggggtctcgtttgggacccccggcggtgggtatcaggcggctccacaagccgatccgggacccaccggcaggggctgagggaagggcagggggactacatgctcgtcaacggagcggtggtggccggtaagggcgccagcacggtcaaggcacggtcggccgacgagctcgaccagatccgggtgctcctgcggacgcgattcgaggagctcgacgcggagtacgaggaggctgtcgcccagagccaccggctgcggctcgtcgagatcggcgactcggccggcgacgaccaggccgacagtgggtccaagacggccgaacgggacgctgccgggtcgctgctgcggaccctgctcgatcggcgcacccaggcggagtatgcgatgcagcggctcgaggacgggacgtacggcaactgtgagggctgctccaacccgatcccggtggagcgcctcgaggtcttcccgtcggcgaccacgtgcgtgaactgcaagcaggtccgggagcggcgggccagctgagctgaaccgggccgggcgtccgtccccgcggtggtttccggaccggcgggggcgggcaccggcaccggcatgggaaacatccggatcgggacctgtggctggaccgacaagacgctgatccggtcggggtggtacccgccggccgccgacaccccggagaaacgcctggcgtactacgcccgccagtttccgatcgtcgaggtcgactccacctactacggtccgccgagcgagcagaccaccaaactgtgggcggcccggaccccggccggcttcaccttcaacatcaaggcgttcagcctgctgaccgggcacccgaccagggtctcggcgctctacaaggacctgcggccggacacggcgaaggccaacgtctacccgcaggacctgccgccgcaagcctacgaggaggtgtggagcaggttcctgaccgcgctcgacccgctcgccgaagccgggaaactcggggcgctgctcttccagttcccgccctggttcggcatccgccggtccaacaaggaattcctgctcgaggtcgcggcccggtgccggccgctgcggccggtcttcgagttccgcaacgcggcctggttcgaaggcggcaaccgcgaggagacgctgggctttctcaaagacaacaatctggcgtacgttgtcgtggacatgccgcagggccacaagtcgtcggtgccacccatcctgaccgccaccgccgacctcgccgtcgtgcgattccacgggcacagcgacaagtggacgagtaaggacatcggcgagaagttcggatatcgatattccgacgaggaacttgcagactgggtgccgaaactgcgcgcgctctccggcgaggcgaagaacacccacgtcctaatgaacaattgtctgtcggattatgcccagcgtaacgccaccactctgctcgacctcctcgacgacgccgccgtccccgccccggccacctgacgcatcccggcgcccgcggcgtccttgccggccgcccacgcacctgccgtgccccgccgtccccggggggcgggtcatccactgtgcgggtggcgcggtttcatcaccggcaccctgctgacggagaggccgcgccgctcggccatccgggccagcacggcggcgtcgatcacggcggcgccgccggggtcgttgttgaaaaagacaaaattgtccggtacgtcatgagccgccacccggtcgagccaggaggcgagggccgcccgcccgtaccgcggccacggtcgcgccccgccctcatggagccgcaggtatccgaagccggcggtccgccacagcggggtcaccggccgcccgccccgatcggcccagcacagtgccgccccgtgccgccggagcacctcctcgcacccggcggtgaaccagctcgcatgccgtggctccaccgccacccgcaccccggccgggaacaaccccagtgtctcgtccagagctccgaggtcggcccgcagattcggcggcagttgcagcagcaccggcccgagcttgtccccgagccccgccgcccggtccagaaaccgccccaccggctcggccggctcccgcagccgcttgatgtgcgtgagataccggctcatcttcaccgccacgacgaacccgtccggcgtccgctcccgccagtcggcgaaggtcttgcgctccggcagccggtagaacgcgttgttcacctccaccgtcgcgaaccgctcggcatagtgctccagccatagccgctgcggcagcccggccggatacaggaacccggcgtcctgcgcccccttgcccggccgccagtcgcggtactgccaccccgacgttccgatccacaacaccccgcccgcatacccacaatcgcaccgcttccaccgcggcatctcccccctccgaggtaggtaagcccctcgggcgcgggatctccgggccgcaccgatcggcgacgctcgatcgggaggacggcggtgggctgttgccgcggcgcacaccgttctgccgggggagccgggcggggccgctgcacggggaatggtcccgcccggcgcccggggcgccccgagagccgcggcggcgcatgaatccgcgatgaacttgggcggtcgcctggcccgggcgccgggcggcgggtagacagtgaggtatgagcgaagagcccgagacccccgtcgctgcggcgggggaccagaccggccccgagttcgacccggccggcgacttcgaatacgacgaggcgcacggcgccgggcatcaccaggacatcccggcgaccctggaggaggaggccgagcggcgtcgcacgctggcggcgccccgctgatcccacgggcggccggtcgatggtgcggggcaacgccgatccgcatgcctcgcacgccaccccgccgcgacattctccgtgcgcgaccgcagcggcagacatggatgggcggccaccggtagccggcggcgggcacccgctgccgggctcagccttgcgcgtactgcaccgccgtgaacagcagcattgccgtgaccaggccggtcaccagcacggtcaccacggtcgcggtgtccagcccgaccttgcgccggtccgcgaccggtttggcggccaccaccgccagcatcgggcaggccagcagcaccagcagcgccaccaccggcgcggcctggtgccagtcgccccgggaggcggcgccggtgctgcgcagaatctggttcccgatcgcgccgaggatgccgccgaccagcccgaagatcacgaacagggttttcaccccgaacgtgatcggccgggccggcggcgtccacttgacccgtttctccacctcggccaggtgctcctgggcggtccggtcgtcggcccgctgccgggggatgctggccggcggcagtctgccgaagcgttccgccaccgaaccgaccttgtgcacgtagtcggaccacagcccggccgcccgcgcgtcgacctcttcgagttcgcgctgggcgtcgcggaccgcgcggcgggcgtcccggacgcgttccccggcgacccggaccgcctcgtcggcggcggcgtgctgttcggcgtgccaggcgacggcttcggtgcgcaggtcggcggcccgctggtcgagggtggtgagccggcgcagcacggtccgatagtcggcccggtcgaagtcggcgcgttcgagatcgctcatgagacaccgtaggggatgatcacctcggcgccgcggtgcaccgagcggtcgaagtgcagcgcccgccagggccgcgggtaccagttgggggcgccggccccggggtagtacggggccagttcgctgccgtgcacgtcgagggcgacccaggcgccgatcgggtcggtccgggagccctgcccgccgagggtgtcgcgcagcagccccgcgccgcgccaccagccgaggacgtgcagccggcgttccgggccctggcgcagcacggtccgcagctggtcaccggcggtcttgccaccggggagcgcatccgccgcgtacaggatgatgaagtgtggccggtcggccggccaggcggcggtggactcggcggccgcgtcctcgaggagccagtcgacgttggtcgcgtcgtaccatccgcagtcggggatcctggcgtgcaacgcctccgcggcggcccgcgcgtccgggtcgaagcaggcgatggagaagcgggcgccgtctcgggcgaactgggcggcgagggaccggccggcggtggccagcaccgcgcacgcctcctcgacccgggtgccgagcacggccaggttgcggccgggggcgcgccgcagcacggtgcgcgccgagcgggacatcacgtcgatggtctcgccgagcagcgcgaccggggcgggggagtcgtcggcgaccagagcccggaagtcggggttgtcggcgagccgcggctgcacgtcaccgtcgaacagccgcggtggcagttcaccggcgggcagccggcgccacagccggtgctgcagcgcgccccactgttcgcggtcgccggccgccgggacgcggacgacctggttcgcctcggtcgccccggagtccggattgaccacggcgtggtagcggggcagcgagtcggcggcggcgttctgttcggccagcacccggcgggcccggggcagcgcgatccgcagcgagaactgggcgaccagcgcaggccggccccacagcgcctcgatgccggagatgtcctggctggccaggatcaggtggatgccctgcgagcggccccggcgggcgaggtcttcgagcaggtcgacggcttcggtggtgacggcgtcccggccggcgagcagcacctggaactcgtcgacgaccgccacgatccgcggccacaccccctgcgggtcctcggcgcgcagctcggccaggttggtcacctcgtgctgtttcgcggcgtcggcgcgccggcgcagctcggtgcccaggaagcggagcagcgccagaccgaactcacggtccgtgttgacgttcaccccgacgaggcggacgtgtggcagccagctctggtcgcggcggcccggcgcgaaccgggcgaaggatacgccctccttgaaatcgagcaggtagaacgccagctcggcgggggagtagcgggcggcgagcgcacccatccaggcgtagatgaaatttgtcttgccggtgccggacggcccggcgatcagcgcatgcggcgggtagtcgctgagcgtcaccatcacccgggtgccctgcgggctgtcgcccagcggcgcggtcagcccggtcgccgaactctcgcgccactcgtcgcccggatccggcagcaggctgtccagcgcgaccggcgccggaccggccgcggccgcttcggcgatctgccggcaggcggcggtcagcaccgccggcggcggccccggatcgagccggacgggcaggtcaccggcgctggtcatgcgcgcctcatcgccgggcgcggcggtcacgaactcgatgccgggcgcgggatcaaccgcaaaaccatgaatgatcaagtgtacgccgcaggccgcgcccgttcgcagcaggcgctccacctgcgtgcgttcgtgccggttcaggtcgccggcgcccagcagcacggcgacccgccacggctccggccgccgcttcgtcgccgcgtgcagctcgcgcagcgacgagaactcgccggccagcaccgtctcgttgatccgccgtacctgggcgaccaggtcgtcgaggagcgcacccagcccgttcggggcgacgaaggtgagcacccgggccggcgcgagcggagcgaaacctgccaggccgccacccaggtgctccgggtcgtagccgatcacccgcaccgtgcccggcgtgctggtgcccagcgcgcgcagcagcagcccggccaccacgtcgtcgccgagtctgcggtcgccttggaccaccacgtgcccgtggtcgagcagctgcaccagggccggcacctcgggggtctccggcgccgcggccggcgcgtcggcgtcccactgccaggggcgttccggctcggccgacggttccggcgcggcgggcagcagcagctagctagctaggggccaggtgtcgtgggaggcgccgcatgggcgcagcggtgcaggtcggcgcggggtgtggccgggtgtgccgcgcgggtgtggcggtggcggccggatccgggtttcctcggatgggcgcgaggaccgcgggccgggtcatgatcgggcctcgccggcgtcgccgtgcgggcgcaggggctccggggcgttcgggtcgagggcttcggcgtcgcggcccaggcgggccaacagcactccggtgagcacgctcgcggtcaccgcgttgtccgccggatggccgggcggccgctgcccgccgcgcggcggcacccggcagatccggtccagcagcgactccagcaccgacggcgaggtgcccggcagcagcgcccggacccggccctcggcggccgtccgcaaccggggcacatcctccggccggggctcgtggcccagcaggtcggcggccagacggtgcagcaccggggcggtcaccgcggacaggcccaggccggtcgatgcggtcaccccgtgcaattcccggccgaggcgggcgcggtcaccggaacgcaccccggccgcgacgcggcgcagcaggtcggcagaattcgtaccctcgatccgcttctgatcctttgccgccgactccccggtgagctgggcgatccgctcctgccaccacgggcccagcttctccggctcggccggcggcgcatccggctcggcggccggcggacgcggctcctccgggcgcatggcctcccgccactcctgaccgcgccgcgccccgggctcgccgccgagacccagaaccgcgagataggcctcgatggcgtcctcggccaggcgcagcgccgccgcggcacgctccgcgtgttcggtggcaccacccagctggggcacgccgatctcctgatgcgactcctcgcgcacccagttcagcagctcggtggcgctgcgcagtttctccagcgcgaccaggaccaggccgtcgggtagctcgtcggaggcggcccggagccgggcgccgagttcctgcaggaccgacatcgcgtcagagcatcgccgtgtagttctgcgcggcctccacggcgacccgggtcgcggtgaaacaatcctcgagcgactggtcggcctgcgacagggaggcgtgcgccgtccccaccgcctcatgggcgccaccgtcgagcgcggccgccaggctctgctgagcctcgccgagcttctcccgagccgcctgtatcgccgcctgcccctcgttcacctgctggacggcggcatccacagccgctctgagctcggcgacactggccactcgttcggcctcctgtaactcaacccacgtgcgttctcagcgtaccgcccggtccggcggccaccgttcccgaccgtccggttttgacaaaccacggacacaaagacgcactcacagtccgacgatcgactccggtgatcgccctgctggtgccgcctccgggacaccgtccattgtggatcatgccggatcgggtccggaggccgcccccgcggacgaccccgttccccggtgatgcccgcaccggccgccggccaatccacccggtagtgcctgcttgccggaatcgtccctcgccggggtgttcggcggcgcccgttcggggggcggtgcgtgcgtcgccgccggctgtccggccacgcgtcgcacgggggtggggtcagcgggggactgcggaggggccgcggacctcggcgcccagggcggtcacccggtcgcgcaggccccggtccgcggtgatcacgacgatgtggcggctgccctgctcggcgtggaccaggtcgacgatcctatcgtcgccggagccgggggcgcgggcgatgcggacgccggccgtggctgccgggatgtcccgggctttgccctcgacgaccaggatgagctcgaccgggccgggtagcccgccgagcccggcggccgggatcggggccaggttgtcgcggaggcgggcggcggcaccggcccgatcgcgccaccacccgtccgggacggagccgacgacgttggcgccgtcgacgatgaccagcggggtcagtggtgccgatgtggccgccggtgccgcggcgccgacggcggcgggtggcgaagtcggctgaggcgtgcgttcaccggacacggcggcctttgatgtggctccctgaaacggggactccgggcaggtcggccccgccggggccgccggggggaccggccgggacgcggcctccgcggaggccggccgagtcggggaccccggggagggtggctgcggcggggacttcgctgacgcgggtgccggctcggggaaggacggctcgcggaagaccggtgtcaggggtccgggagcgggcttcggggagtcgggcatgaagttgagtctactcctgtcaactttttgccggatccgggaatcaacgtcccgtttcccgcgctgttgacagtcggcggcgggcgtttgcccccaccggacccgggtaggccccgggtgcgggccgctggtggaagtaccaggagaagagagactgatgagcatcggaccgatggggccgggtggacccggtcagtgggacgacctgttcgcgcgcttcttcggtgcggcggagccgcgccgggcggcgcagcggatcgatatcgcgcgctacatgagcaacgacgcccgccgggtgctggccgacgccgcgcggcgggccgccgacctcggggccggcgacggcctcgccgacctcgataccgatcatctgctctgggccgttctgcagcaggagccgatgaagcagaccgtgcgccgggccggcgccgacccgcagaccctgctcgccgagctggaggcgcgactgggtgacgacgcgtcgcggaccgcggcggcgaaccggcgggccgacatgggcgccgaccgcgacgggccggagcaggtcgcgctgaccccggccgccaagcgggcgctgctggacagcctgcagatctcccgagccgtgggcgcctcctacatcggcccggagcacatcctgatggcgctcgggctgaacaccgactcggcggccgggcggatgctggccggccggctcgacccccgggccatcccgaacccggagaccccggccggtccgcccggtggcggccagggcggttcccggggcggcgggcgtggcggcgcggcggcgaccccgacgctggagcagttcggtgtggacctgaccgaggtggcccggcgcggcgagatcgacccggtgatcggccgggccgacgagatcgagcaggccgtggagatcctgtcccggcgcaccaagaacaatccggtgctgatcggcgaggccggggtcggcaagaccgcgatcgtcgagggcctggcccagcggatcgtggacggcgaggtgccgctcaccctgcaggacaagcgggtggtgcagctggacctggccggcctggtggcaggcacccggtaccgcggcgacttcgaggagcggctgcggaagatcatcgacgagatccaggcgtccggggacggcctgatcgtgttcatggacgagatccacaccctggtcggcgccggtggcggcggtgagggcggcgggatggacgccggcaacatgctcaagccggccctggcccgcgggcagctgcgggtgatcggcgcgaccacgctggacgagtaccgcaagcacatcgagaaggacgcggcactggcccggcggttccagccggtgctggtcggcgagccgtcggtggaggacgcggtggcgatcctgcgcgggctgcgggacaactacgaggcgcaccaccaggtgcggatcaccgatgaggcgctggacgcggcggccgagctgtccgaccggtacgtcaccgaccggttcctgccggacaaggcgatcgacctgatcgaccaggccggcgcccgggtgcggctgcgggtgaagacgccggacaagaacctgcgcgagcaggagtggcagctggagcagctgtcccgggaccgggaccaggcggtgcacgcggagaactacgaggtcgcctcgcagctgcgggatcggatcaacgagctcaaggcgcggatcgccggagccggggcgggcgaggacggcgtgccccgggtgaccgcggccgacgtggccgaggtggtgtcccgggcgaccgggatcccggtggcgcagctgaccgaggccgagcgggaccgtctgctgcgcctcgaacagcacctgcacgagcacgtgatcggacaggacgacgcggtggtcgcggtcgccgaggcggtccgccgctcgcgggccgggttgggtgacccggaccggccggtcggcagcttcctgttcctcggcccgaccggggtcggcaagaccgagctggcgcgctcgctggccgaggcgctgttcggcgaggcggaccggatgatccggctggacatgagcgagttccaggagcggcacacggtgtcccggctggtcggggcgccgcccggatacgtcggctacgacgaggccgggcagctgaccgaggcggtgcggcgccggccgtacagcgtggtgctgctcgacgagatcgagaaggcacacccggacgtgttcaacatcctgctgcaggtgctcgacgacgggcggctgaccgacagccaggggcgcacggtcagtttcaagaacaccgtgttgatcatgacgagcaacctggggtcggacctgatcagcgggaccacccgcagcgtgggcttcggcggcggcgagaacggccgctcgccggaggacgagctgcgggaccggctggaccggcggctcaaggagcagctgcggccggagttcatcaaccggatcgacgagatcatcatcttccggcagctggagaccgaccagctgcggaagatcaccgagatgctgctggagtcgacccggcggcggctgcacgggcaggacgtcacgctggagctgaccacggcggcggtggactggctggccgaccgcgggtatcagcccgagttcggcgcccggccgctgcgccggacgatccagcgggagctggacaaccggctgtcgaggatgctgctcgcggcggacctggcgccggggcagacggtgacggtcgacgtccgcgacggcgagctcgccttggaggtgtcgtccccggcgaaggtcacggctcgatagccgccgggagccgggtgcccgcccggccgtcgtcagcacctcgccgcaccggatcctccggcgcgccgccggcctgcggatagcattccgtggccggcggcgcgggccgcggagtcggagcgggaggacccggtggcacgcgaggtgacggctgggctgcccggaccgggcgacgggctgcccggaccgggcgacatggtcctggtcaccggcgagcccggagccggcaagtccgccctgctggaggacgccggccggcactgggacggagccgtgttccggaccgcgggcacggccgccagcgccgccgagccgctggcggcggccggcgtcctgctaccgggctggtctccggcggacgccggtgccgccgcggtgcgcgccggcgtcggccgtatccgcgaactggcgaacggccgcccggtgctggtggtggtcgacaacgcgaaccatgtggccccggagtcggcggcgttgctgcgccgggtggcgccggtctagctagctagccgggtcgccggcgacgtggccctgctgggccgggccctggtcgcgcgggaccgaccggtcgaggcggaggaggcgttgcggcagacggcctgcgcgcaggtacgggcgctgaaccggctctggggcctgcgccgggccgagccgccggccgtgaccgccggccccgccgcccaggccgccgcgctcttcgtgcccggtgtgccggcgacggcggcgacggcagtcgacagtgccgatccggtgctggccgccgcggacgcggcgctcaccacgttccgtctcgtcttcgccggggcgcccgagcgggtggtccgggagaatcgcgagctgccgcgcctgtggccctcgatgcgcggcgcggcggccgcctgccgggtgcacgccctggtgctcaccgggcggatgaccgcggcccgggacaccgcccgggcgtactacgaagcggccgtggccggcggcgagccggccgaactggcaccgctggcgctgcagcgcggggtgtgcgagtggtgggccggcagcccgcgacgggccatgcccttcctgcgcgaggcgatggcactggtggacgatcgggtgccgttcccgatccgggcctacgtccgcagcgagtacgcggtctgcctggccgccctcggcgacggaccgcaggcgtaccgactgatcgccgccctgcgcaccgagcagagcgccgggcccgggctggacgggcagctccgcacgaccgaactgcaggtcatggcgttgaccggccggtatgtgcacgccgcggacctggccgtcgcgctggccgccgacctggtggccaccggtcgggacaccgagcgggtggaggcgctgtacctggcctgccgcctgcgtccgtcccgggccgtcgcggccggcctggcagccgccgtggacgccgccgacagcccgttcttcccactgctcgcccggcacgcggtggcgctcgccgagggggacggcgcggagctgatccggtgtgcggacgcgttcgagcgcagtgggtatccggggctggccgccgaggcgtgcgccggtgtcgacgaggcccgggcgcggcgcctggtcgacagctgcgacggtttccggcccgcctggctgcccggccgctcggggccggcgacgctgaccggccgggagcgtgaggtgtgcgagctcgccgccgcgggactgtccaacgcgtcgatctcgcaacggctcggcatctcggtgcggaccgtcggcaaccacctgcagcgggcgtacgagaaactgcacctcaccgggcgccgcgacctgggcgccgcgctcggcctcagctgaccggagccagcgcggcggccagttcctgccgcccgcggacgcccagcttggcgtaaccacgggccaggtggttggtcaccgtgcgtacggcgatccccatccgctgcgcgatctgccggttgtcgagtccggcggcagccagctcacaggcctgccgttcgcgcgcgcccagccgcaccggcccgggcgggaaccgcaaccaggccggccggaaaccgtcgcaggccagcgtcagccgggcggcgacccgcgcgccctcggcggtgccccggtcgtcgccgtcgcgccgggccagccccgccgcggccgccaccgcctcgagcgcgaagccggagtagccgcccgcctcgaaccgatcggccacctcgcgcaggccggcccggtccgcgccggcgagcgccgtggcgtgcgcggcgaacagctcgaacagctccccgtcgcagcggcgtgccaccgcggccagccggttcgcgacatccgggtccccggtcagccgggcggccaggtagtagccctcggccgcgctggtcagccgcccttcccgcaggttgccggcggcgcggcgcaccgcggcttccgcggccctggacagctccccggtcagcgccagcacccggatctccccgacgagcagatggttgcgcagccggccgccggcgggcagggcggctcgcgcgccggccagcatgcgcaacgcccgcccaccctcccccacggcggccaggcagacggcgtactcgctggtcacgtatgcctgcaccgggtacggcacccgatcgtcgagcagcgcggccgcctcccgcaggaacggcaacgcccgggccgggctgcccgcccaccactcgcacaccccgcgctgcatcgccagcggggcgacctcggccggttccccgccggtgacggccatgtcgtagtactccgccgcgacctcccgggcccgcgcgagccgcccggtgagcaccagggcgtgcacctggcaggcggccgctgagccgcgcatcgacggccacaccaggtcggcggcgtgctccgcggcgatccggcccggccggcctgtgaagatcattcggtagccccggacggcggcggccgtgctggccagcagcggatgccggatcggcgcactgcgcaccggcacgccaccgccgaccgtggtgaacagcgccaaggcctcgccggccagttcgagctccggcgggtacggcggctgcgccgcggcgaacgcctcccgcgccacccgggccgcttcctggggccggcgcagcccccacagcagattgacgatccgcagtgcgcgcgacgacggcggcagcgccgcgccgatccgggcgaacagctcctcggcgtcggtcacccggccctgtacgagcagggcctgggcccggacgtccgcgtgcgccaccgagtcgccggcgccggccagccggtgcgccaggtcggcgtcgccgcgagccagtgcgattcgcgcgtgcgccacgcgccgcccgggcgcgacggccagaccaccgcgcaccagccagtccaccgtccgcaccggatccgcacgggccgccgtcgcggcgccggccagctcgcgcaggagccgggaacggtccgtgggggcgagctgttcccggagcaacgccgcgtacaacggctggctcagtcgcaggaccgcctcgccgccggccggctccagccggatgatctcgtgttcctccagcacctccagcgtgcgggcatcgaccagccgctccagcaccgggaccggcaccggaccggccacggcgaggtaccgggcggcggtggtcggcggggtgccggtcagcgccgtcaccgtgtcacggaccgcgtccagcggcagccggccggaccagcgccacgtgccggcccgccggatcagcgtcccgctcgccggcgccgccgccagcagcgcgcgcaacagccccgggtttccctggctgtaccgcagcagctcggccaccgtcaccgcatcggcgcgtccgccgagggtggcggtgaccacggcggcgatgccggccgcggtcagtggcggcacgggctcgcgtcgcaacgttccccgccgcagcagcggcgcgaccggtgcggcgcaggtggcgctgctcggcgcggtggccaggagccgcgccacctgagcgtcggcgaggtgctcgacgaggtggacggtgtccgtgggcagcaggtgcaggtcgtccacggcgagcaccagcgggcggtcgaccgcgcggcggcgcagcgcgcgggtcgtggcggcataccgccgcggcgccggtgctgccgacggtgccggcagatcgtccggccggagcaccacggcccgcccggaacaggcctgtgccaccagagcgagcagccgggtccggccgatcccgggcggaccggtcagcaggatgccaccgggcggcggcgcgccggtcagcatcgccgccaaccggccggccagcggatccggcatcggcgcgatcccttctgctcggtggtcgcgggccagcgtgccgggacccggtgtcccggcgcaaccggacgatggcgaattgagcagcgattactcaggtggtcgggcgtcgcggtgcaccaccatgggcaggccccgcgatctggaaggaccgaatcgttgacctcccgtacaccccgacgaagccggtggggtctgctcgccgccggcatcctcgccgtcaccctggccgggctcggcgtgccgctggcgctggccggcaccggacgacccgcggccaccggccccacccgtgccgggctgctcaccacgctggactgggagaacgccgccgatcgggcgctcccgccgcccggctggcagcggcagtactgttgcgccaagtcgctgcaggtcgtcaccgacccggtgcgcgacggcgggcacgccgtgcagttcaccctggaccgcggcgacccgcacgtctccagcagcacccgcagcgagctcagccagcccgaccggcagccccccgggctggaccggtggtacgggttcagcgtccatccggcgcgcgactggacggtggaccgctcctcggagatcgtcagccagtggcatcagcagagcgacaacgggtctccgccgctcgccctgctgaccaacaggggggattggaagatcgactttcggggcgagatgatcgacctcggcacctatcggaccgttagctggaccgactgggtcttccacgtcgtctggcgcaccgacacctccggcgtcctgcaggtgtggcgcgacggcagcctggtgctcgaccgcaagggccgcacccacgacgacgcggcgcactccccgtacttcaagttcggcatctacaagtgggactgggacgggcggccgaaggtttccgacaccagccaccgcagcctcttctacgacgctctgcggatcggggaccagcgggccggctacgccggggtcgccccgggcggcacggttgcggtgtccccgccgccatccgccggctcgccgggcccgagcgggacgacgccgtccgatccggcgtactcggtggtcccggcgacgcagaagatcgcccgccggtccaccgtcaccggcacaccccgggccgtcctggccggcgcccgcaacgagttcgtctccttccaggtcgtcctcgccggtggtcagcgcggcgtgtcggtggcgccgggccgggcgctgagcggatccggcgggaccatcccgaacagtgctgtgacgatctaccgcgaggactattacacgaccaggcaggcgtcggccggtgggcgtgccgtgggtgcctggccggacgccctgatccccgcggtggaccggctctacggcgaacgccgcaacgcgttcccggtggacgtcccggccggggagaaccgggtcgccttcgtcgacgtgctggtgcccgcgggccaggcggccggcggatacgacggctcgctgaccgtcaccggcagccggggccgcgccgacctgccgatccacctggacgtgcacggtttcaccctgcccgccacctcgtcgctgcgatcgctctggagcatcggctggtcgaccggctgcgacgcgctccacggctcgtgcgacgcgtggtccagcgccgcgaacctgcagcgtgcctggcgcaccaacgcggacttcgcccggctcgccctggacgatcggatgaccgtcgccaacgcgcagttccagcctccggccccgggcagtcagcgggccgccttcgaccggtatctgctgccgctgctgcgcggcaccgcgcagacccagcttcccggcgcccggctgaccacggtggcggtcgatccccagcaggtgcgggtctggaaggcggtcgccgatgccgagggcttcgccgaccgggccgtgacctacgacgcgcacgactgcgacgagccgggcagccgcgcggccaggtggaacgcctgccgcgccgccgtcgccgggtacaagaaggcgtggcccggcctgccgaacgtgatgaccgccgagctgtccgacgtcgaccggtacgaccctcggcacgtcgtcaccgacatcgtcacccccgtggtggaccacttcgacgacagctccggggaccagccggccgcgtaccgggcgttcgcggcacgacccggcaaacagatgtggctctacacctcgtgtgacgtgtccggttgcggtggcgccgacgagcaggacgccgagctccgtctgccctgggtcgactacacgatcgacacgcaggcggcgcagaaccgggcgatggggtggctcgcctaccggtaccgggccaccggtgagctgtactactcgacgacccagcagctgggcaccgcgtggaccgaccagtggggcttcggcggcaacggcgacggcacgctgttctacccggggacgacggcccgcatcgggggaagcacgccgatcccgctggagtcgctgcggatgaagatgatccgcaacggctatcaggactacgaatacctgcgcctggccgaccgggcgggccggtccgccgcggcgcggggggtggccgcccggctgtacccgtcgatgcacgcggccgctccggcaccggcgtcgatcgaggccgcccgggcggagctgatcaccctgatcgagggccggccggtggccgcccgatgagcgcgggcgtgggcggggaacgcctccgcccacgccacggcccaccccggacgatcgtcaggcgaccgccaccgtcggatgatcctgactccacgccacatatccggcattccggttgataacgtcctgatacgcctcgcgggccagttccagcacctgcggcgccgagcgcgccgccggcgagtccggatgccagccgaggatcagccgccatcgcagcggcgcccccttcagcggccgcgtcgtcaggccggccggcggccggaacgtcggctggcacagccccagcgcgacccccagctccaccatgtcgatgcaggcccgcgcgtcggcctcgagcacccggcgcggcgcgaaaccggcccgggcgcaggcggtcgcgaaacaggtctcgaagcagccgtcgccggccgccgccgaccactgctcgtcggcgagttcgccgaggtcgacctcggcccccttggcctgcggatggtcctcgggcatcagcacgcacaccgcgtcgaccgcgatggtgtcccagaccagcccgtagtccgccgagggcagcgcgtcgccgcacaccccgacctgggcgaagtcgagtttgccgttgagcaccatggtggccagctcgtcgacgtagtacgaggcgtaggtcgagatctgcgcctccggccgggcggcggacagccggtgcagcaggtgggcgaagaccggcccgccgatcgcgcccatccggtagcggctcatcgtggagccacccccggccgccagccgggccgcctcgtcctgcaggcctttcatcgccggcagcagcacccgggcccgggacagcacgagctcgccgagtgcggtgggccgtgcgccgcgccggtcccggtcgaacaggggaccgccgagggtgcgctcgatccgctgcagttgggcggtgagcgcgggttgggccaggccgagttgtgacgcggccttggtgacgctgccggtctccgcgatggcgcagaccaccttcagatgccgcagctcaaggttcatagcgtgacgttaggaccagaaagggatcgaaggctagccctgtaacccgtgacaaacttgttaagtaacgggagtaaacatccgaaaactacagatctttcgcgtacgtcgtacgtgccgtcgccacgtcccggagcttgtcgaccacgccgagcagcggatccacgatcttgttccacggcggcgtgaccggggtggacgggtgcggccgggtcggcgcggcctcctgcgcggtctccacccggttgcccagccggatcatgtcctcgatcggcaccatctgctccagcagcgggaacagctcgtccgagtcggcctcgacgtgccggcgcaccgccgcccgcagcgtgcccatctccaccccgtcgcgcatcatcaccagcagctcacggtcctcggccagctcgcggtcggcgatccggtcgccgtccggcaccgccgtgcggaccgccgggtagagatactgctcctcggccgacaggtgccgggacagggtggcgatcagcacgtcgcgggcccgaccggactcgtcggtcagcgcccggtcggtcaggctgaggatctgccggtgctgctcggacaggacatcgacgacgttacgcccggaggtggcgccggccaccggcggcagcggcggaagattcacgtcagacatgaccgcgccggtacccgttccgcctctcccgccaaacgtctgtgacatccggctggtaagaagggcggatggaaacctccgccgatgaggtcgtcgacctctgccgggatctgctgcgcatcgacaccaccaacaccggggatccgcggaccacggtgggcgaacgcgtcgccgccgagtacgtcgcgacgaaactcgccgacgccggcatcgagtcgcggatcctggagtcggcgccgacccgggccaacctggtcgcccggatccccggcgcggaccgttcccgcggcgcgctgctcgtgcacggccacctcgacgtggtgccggccgacgcctccgagtggtcggtggacccgttctccggcgagatcagggacggctatctctggggccgcggcgcggtcgacatgaaggacttcgacgccatggtgctcgcggtcgtgcgggactggcagcgcaccgggtacgtgccgccccgcgacatcgtgctggcctacaccgccgacgaggaagccggcatggagttcggctcgcagtggctcgcgcagcaccacgcggacgtcttcgagggctgcaccgaggcgatcggcgaggtcggcgggtactcgtacacggtcaacgacaacctgcgcctctacctggtgcagaccgccgagaaggggctcgactggctgcgcctgcacgccagcgggcggcccgggcacggctcgttcatccacgacgacaacgcggtgaccgcgctggccgaggcggtcgccgcggtcggccggcaccgcttcccggtggtcgtcacgccgaccgtgcgagccttcctggagcagatcagcgacgcgctgcagatcgacctggacccggacgacccggagctggcgatcgccaagctcggcccgatcgccaacctgatcggcgccaccatccgcaacaccgcgaatccgacccggctcgcggccggctacaaggacaatgtgatcccggggaaggcgtcggccaccatcgactgccggaccctgcccggccaggccgagtcgttcctcgccgagctgcgtgacatcatcgggccggatgtggagatcgagcacgtgcaccggcagccggccgtggagaccgagttcggcgggccgctggtggaggcgatgggcgcggcgctgcgcgccgaggacccgggggcgcgtaccgtgccgtacctgatgtccgggggcaccgacgcgaaggcgttcagcaccctgggcatccgatgcttcgggttcgccccgctgcaacttccgcccgacctgaacttcgccgccctgttccacggcatcgacgagcgggtgccggtggagggactaaagttcggcgtacgtgtgctcgaccgtttgctccgcaacagttagctgttcggctccaccaggtggaaggacccccaacgaagatgagcgaccagaacgctgagctcgacgccgcactggagcgggtcgtggaggcggcgcgggcgcacctcgcggccgtgaaggcggccgcgggccggatcgacgacgacgacgtctggcaggcgtacgtcgacctcaacaacgcctcgttcgcctacgacgagaagctgctcgacgcgttcggcgaagtcacgccgtgggacgtcgagtcgatcgaccccgacgaggccgaccagcgcttcctggccggtgaggccggcgccgacggcggggccggcgacgcgtacccgcaggtgatctcggtccggcagcgccgcgactaccgggtgccgagcgtctccgccctgctgcgggtcgccgagaacgcccggaagaacgcggtgcccgaggacgaggaggtcggcccggtcgagtcggtcggcgaggccgtcctggagctgctgcaggccggcgacggctcgctggcctcgctcgacgtgcccgagctggagccgctcgacggcctgctcaccgtcaccgaggtcgaggccccgctggacctggaggccttcgacgacgcggacggctccggcccgttcgccccggccgagggcgatcagctggtcggccgcctcgacgagcacccgttcctgcccgacgaggaagacgaccacgccggccacaaccattagcacccgctgaaaagcccgcccgggatccgggcgggctttctcagtagctgaggccgggctgcggcgtggcctggagccgccggcggagcatcaccttgcgggtaccgtccgcgaacagctgcacgcgggccagctcccacccggagaactccgcggcgatggcgagctgcgccgccgcggtcagacgatcgacattcgaaggcaaccgcagcggcgcatattcgtagtccatgggacacatcgtgctcctgcgaccgcgccgtcgacaaccctttgacctgctgttcagggtgtgatgaagccggacttgtacgcggtgacgacggcctgggtgcggtcgcggacgcccagtttggccaggatgttgccgacatgggtcttgaccgtctcgacgccgaggaacagccgggtggcgatctccgcgttggacagtccatcggccatcagggtgagcacctcggcctcgcgcccggtcagcccggcgtccctgaggccgccgtccggacgggcgtaggcggccgccagactcttgatcgcggccgggaagagcagcgagtcgccgcgggccaccacccggaccgcctccacgatctgctccgggcgggcgcgtttgagcaggaagccgctcgcccccgcctgcagcgccgtgtagacgtactcgtcgttggcgaaggtggtcaccacgagcacccggggcgcgtccaccgggaagcggtcgagcagcagccgggtggcctggatgccgtccaggtgcggcatccggacgtccatcaggacgacgtcgggccgccgacgcagcgcggccggcaccacctcggcgccgtccgcggcctcgccggtgacggtgatcccgggctgggcgccgaggatggcccgaagcccggcccggaccagcgcgtcgtcgtcgacgatcagcacgccgatcatcgggcgcgcaccgggagccgggcggtgacccgccagttctcgccgtccgggccggcggtcacccggccgccgagcagccgggcccgttcccgcatgccggcgatgccgtgcccgcccggccgggcgtcgcccgccccgcgccggttggtcaccgtgatcatcaggtccccctcctgccggatgcgcagcgtgaccgggccggtcccgtgccgcgccgcgttggtcagcgactcctgcacgatccggtacgcctcccgggacaccgccaccggcagctcgccgaccgtcaccgaggcctgcacggcgccggtcagcagctggtccagatcggtcagtgtcggtccggtcgcctcgtcgcgcagcaggcccagcacggcgtcgagctcaccggccgcggcccgcccggtctcctcgatcgcggtcagggcctgccgggcgaactccgggtcgctgtcgaacaccgcccgcgccgcgccggcctgcagggtcatcgcggtcagcgcgtgcccgatcgagtcgtgcagctcgcgcgcgagacggttgcgctcggccaggtggtgctcgcgttccgaggcggacgggccgagcaggatcggggccatggtggcggccagcgagcccagcccggcgaccgcgtaaccggccccggccaggatgaccggcgcggcggccagccaccaccagccgccccggccgaacgcctcgccaccggtcagcgcgatcaggccgaccgggaccacgatcagcagcacggcgccgaccagcaccccgctgaccagatgcaggccgaaccagagggcggagcgcagccgggtctcccgctccatccggtgcccacggtcgtgcccgggcaggccgacgccgagcagcgcccgagccgcggtgatctccagctcccgggtgccgctcaggaacgccggcaccagcgcgaggccgccgatcaccagggcggcgaacgcgacccgcggccagtgccgcgggtccgcggcgacgagatgggcgacgaatcccgcggcgatggtgtacggcagggccagcaccgctccgagcagcaggaacaccgcgcgacgcatgacggcgtcagcgcgccccgtgcggatcgccggcaccctcacgctccggatacccgacgtcgatcgccgacacgtcctccagcgcacgggcgatctcggccggcagcaccagctcctcgctgcgcagcgcgccctgcagctggccggcggtgcgggcgccgaggatcggggcggtcaccccgggccggtcgcggatccaggccagcgccacctccagcggtgacacgccgagcccgccggccgcggtgaccaccgcctcgacgatgctggagctgcgtggctccagataggtctgcacgaacggcgcgtagtgctcggacgcggcccgggaatccagcggccggccgttgcggtatttgccggtcagcacgccgcggccgagcggggaccaggccagcacaccgaagcccagcgccgccgacgcgggcagcagctcccgctcgatgccgcgctcgaccagcgaatactccatctgggcggcgacgatcggggcgcgtcccggatacgccgactgccaggtggcggcccgggcggtctgccaggcggcgaagttggacaccccgacgtagcgcaccctgccgctggtcaccgcgtgatcgagagcggacagtgtctcctcgaacggggtctgcccgtcgtagccgtgcacctgccacaggtcgacgtagtcggtgccgagccggcgcagcgaggcgtccagcgagcgcagcaggttgcctcgcgagccgtcgcgggcccgccagccgtgcggggtgaggccggccttggtggcgatcaccacctcgtcccgggggaccaggtggtcgagcagcgagccgatcaccgcctcggcgtcgccgttgccgtacacgtcggcggtgtcgatcagcgtgccgccggcctccaggaacagtttcatctgctcggccgcgtcgtcggggtcggtgtcgcgtccccaggtcatggtgccgagcgcgagccgcgagaccgctagcccgcttcggccgagcggtcgctgatgcatgagtgaactttattcagagctgttccgtaaagaaatcctccggcccgtcagggtgccgtcggttaccggacggaaacgtgaacccgggggcatcagtaggctggggcggacagctcaagatctcgggagggcagggcagtgcggctcggactcagtctcggctaccagacggcgtggagcacgcccgccgaccacctcgccatggcccgggaggccgaccggctcggctacgcggtggtctgggccgccgaggcgtacggatcggacacggtcagcatgctggcctggatcgccggccagacggaacggatcgacatcggctcggcggtgctgcagatcccggcccgcaccccggcgatgaccgcgatgaccgcggccaccctggacaccctgtccggcagccggttccggctcggcctcggcgtctccggcccgcaggtctcggagggctggcacggcgtgagattcgccaagccgctcgcccggaccagggagtatgtcgacatcgtcaagatggcgctgcgccgcgaccgggtgcagtacgacggcgagcactaccagctgccgctgcccggcggcgccggcaaggcgatcaagctcggcttccacccgccgcgcaccgagatcccgatctacctggccgccgtcgggccgaagaatctggagctcgccggcgaggtcgcggacggctggctggccatcttcttcgccccggacgccgccgacgaccagctgcggcacatcgccgccggtcgcgcccggcacggtcagggcctggccggcttcgacgtggcgcccagcgtgccggtggtggtcggcgacgacatctcggcctgcgccgacgtggtccggtggtacgccgcgctctacatcggcgggatgggcagccgggagcagaacttctacaaccagcttgcggtacggatggggtacgcggacgccgcgcgccgcgtccaggatctgtacctgaacaggcaggtggccgaggcggccgaggcggtgccccaggagttcatcgaacgcacctcgatcatcggcaacaaggcgcagatcaccaaacggatcagggagtacgcggcggccggcgtcggcaccctgtcgatcagcccgtacgtcggcgacctgcagtccggcctcgacacgttgcgcgtggtcgccgaggcgtacgaagagtccggcgtggcccgctagtggccaccgtcctgttgctgcggcacggccgcaccaccgcgaacgccaccggcgagctggccggccgccgcccggtcgagctcgacgagaccggccgcacccagtccggccgggtcgccggccggctccgcggcctgcccctggcggccgtggtgtccagcccgctgatccgctgccggcagaccgtcgagctggcgctgcccggggtcaccccggtgctggaggacgggctgatcgagtgcgggtacggcgagtgggagggccgcccgctcaaggagttggccaaggagccgctctggccggtggtgcagcagcaccccagcgcggtcaccttccccggcggcgagtcgatggccgccatgtcggcgcgcggcgtcgcggcgatccgcgactgggacgcccgggtcaccgccgagcacggggccggggcgatctggctggcctgcagccacggcgatgtgatcaaggccatcgtggccgacgcgatggggctgcacctcgaccagttccagcggatcgtcgccgacccggcatcgatcacggtgatccggtacacgtcgacccggccgttcctcgtccgggtgaacgacaccggcgagctggcctccctcgtaccgccgaaaatcgatggggacaagcccgccgagagcagtgacgcggcggtcggcggcggcgccggaggcggcgtctgacgaccgagcgtgatcgggctgtcgccgcagcgtgcaccctattgcgcccagggcgaaccggggtcgtcgggccgggcgcgggcggccgtggatggctagggttggttccatgacccaccaagtgcatgccttcgagccgcccgagcggttcgtcgccgggacggtgggcgagcccggggaccggacgttctacctgcaggcccgcggtggcggccgggtgatcagtgtcgccctggagaaggtccaggtgtcactgctcgccgagaagctcgaagagctcctgctggaggcgaacaagcggttcggggtcaccctgcccgaggccccgctgctggccgtgcacgacaacgagccgctggacaccccggtcgacgaggagttccgggtcggcacgctgggactggccttcgacgtcgacacggccaccgtggtgatcgaggcgatcgaggccggcgaggccgaggtcgagatctccggcgacccgctcgccgaggacgacaccgaggacgagggcgacgacgaggacgaggacgacgagcccgacgacgacctcgaccggctccgggtccggctgacccccgaggccacccgggcgttcatcgaccgggcccgccgcgtggtcgccgccggccggccgccgtgcccgctctgcggccagccgctcgacccgggcggccacctctgcccccggcacaacggttaccaccggtgacagccgagccgaccgaggtgctcgccgaggccgacgccctggagctgctggcccgcgggcagatcgagatcgagggccggctggtcgacgcgtcgaacacgacgctgcgcgccgagatcagcctggccgggctcacccgccggtgcgtctacaagccggtccgcggcgagcgcccgctctgggacttcccggacggcacgctggccggccgcgaggtgtcggcctacctggtgtcccaggccaccgggtgggacctggtgccaccgacgatcctgcgggacggcccgctcggccccggcatgctgcagctctggatcgacgagccggaggcggccgagtcactgatcgggttcgtgccggcctacgacgtgccggcgggatggtttccggtggccgcggcccgggacgacgacggcgacgcctacgcgctggcgcacgccgacgacccccgcctggcccggctcgccgtcttcgacgcggtgatcaacaacgccgaccgcaagggcggccacgtgctctacccgtcgaccggcacggtgcacggcgtcgaccacggcgtcagcttccacgtggagaacaagctgcgcaccgtgctgtggggctggaccggcaagccgctgcccgccgaggccgccgaggtgctcggccggctcgcggcgggcttggacgggccgctcggcgaggcgctggaggagcacctgaccgtcgccgaggtgcagcacgtccggctgcgggtgaaacggctgctgcgggccggccgcttcccgaaaccgccgaccgactggccggccatcccgtggccgccgatctagaggtttacgtcacgcccccggaaaactgtccgaggggctggataggctccggggatggacgcttggaccgggcatgacgtgccgaccctgccgggggacgcccccacgctgaagctgtacgactcggcgcgccggtcggtgcatccggtcacggcgggcggcgcggccggcggcgccgcgacgatgtatgtctgtggcatcaccccctacgacgccacccacctcggccacgccgccacgatgatcgcgttcgacctggtcaaccgtctgtggcgggacgccgggcacccggtcacctacgtgcagaacgtgaccgacatcgacgacccgctgctggagcgcgccgagcgcgacggtgaggactgggtcgtcctggcgatgcgcgagaccgccctgttccgcgaggacatggaggcgctgcggatcatcccgccggcccactacgtcggcgccgtcgagtccatcccggcgattgcggggcacgtccgcgacctggtcgccaatggcgcggcgtaccgtctcgacgacggcaccggcgacgtctacttcgacatcaccgccgcaccccgctggggctacgagtcgaacctgtcccgccccgagatgaccgagctctccgccgagcgtggcggcgaccccggccgccccggcaaacgcgatccgctcgacccgttgctgtggcgcggggcccgcgacggcgagccggtctgggacggcggcgacctcggcccgggccgtcccggctggcacatcgagtgcgccaccatcgcgctcaacctgctcggtgacacgatcgacgtgcagggtggcggcagcgacctgctctacccgcaccacgagtgctcggcggcgcacgccgaggtgctcaccggcgcggcgccgttcgccgggcactacgtgcacgccggcatgatcggcctggacggggagaagatgtcgaagtccaagggcaacctggtcttcgtctcccggctgcgggccgacgggatcgacccgatggcggtccggctcgggctgctcaccgggcactaccgcgccgaccgggagtggaccgacgaggtgcgcaaggcgggcgagcagcggctggcccgctggcgggaggcggcggccgcgccggccggtccgtccggcacggggctgctcggcgcggtccgcgaggccctcaccgacgacctggacgcgcccgcggcgctggccgtggtcgacgcgtgggtcgaggcggcgctgtccggggccggggacgacaccgcgggtccggcgctgatggcgcagaccgtcgacgcgctgctgggcgtccggctctgagtccgccggccgtcaccgggcggtgtcgcatgccgcttcggtgatggtgccgatgctgagtgaacggcccgtccgaccttttcgggcgggccgttcgcgtagccggaatagcttccgggtggcgcgttattccggcttctccgcgggtatcgggcgcggtttcgggcggcgagaaagcaccccccggacggactctagacgttgatcacggcgcgtcgcggcaattcggctaaataacgcactttacggttttattcgtcggaaatccgtgcattgtggcggctgccgcgacatgctttcggaggtcaaaccaacgtccgaaaggaaccaacatgcgtcgtccggctatgtacctcgccggtctgttcctggccaccggcgcgagcctcgcactcgctgcccctgcctcggcggccggcacccactgcaagaagaactacggcgccgcggctgtccacggatacgggcacggtgccgcgtacggccacgccagcgggggtggctggtacccggggggctacgagtacggctacccggtcggctacgaagacaacgacttgtactaccagaacaacacccaggtcggcctgatcaacatcaacggcgggccgttcggcttctgatgaagccgatgctcgcgggaaccggaattccggacccgcggcggtaagccacagacccgaggagcctttcggctcctcgggtctgagctttttctcggccggttcggcacccggctctttgatggccggcgtggctgacaaggggtcgcgcagatatgtctgcccgatcagataggcatcgaagcggtagacctcccgccggccgatcagatcagctcggcgtcgtgcaccaggagagcgatctgcacccggttgttcaggtccagcttggtcagcaaccgggacacgtgccccttcgcggtcggcacgctcatgcccagccgggcggcgatctccgcgttcgcgcagccctgccccaccagcaccgcgacctcccgctcccggccggtgaggtcgtccagccggccccgcgcccgggcccgccgggtccccgccgccggatcggcgacgtgatcgatcagccgccggatcaccccgggggagaggatcgccttccccgcggccaccgtccgcaccgccgccaggatctccagcggcggcgtgtccttcagcaggaacccgctcgccccgccccgcagcgcctccagcacgtagtcgtccacgtcgaaggtggtcagcacgatcacctgcggagcacccgcccgctcccggatccgccgcgtcgcgaccaggccgtccacccgcggcatccgcacgtccatcagcatcacgtccggccagtgcgcctgcgcggcccggatcgcctccgcgccgtctgccgcctcggccaccacctcgatctccggcgaaccgcccaccaggatccgcagcccggcccgcaccagcggatcgtcgtccacgatcgccacccggatcggccgcaccccgccgtcgccggcggccgcgggagaatcgggatcgcccgtcaggccggccacggcagctccgcctccaggcggaacacgtcgcgctccgcgccgtagcggaactccccgccggccagggccacccgctcgccgatcccgaccaggccgaggccggtgcgcggcggcgccggatccggcgtaccgccgatcgggttgatgatcgtgatccgcaggccgcggccggcggcgcccgccatgcgcaccgtcgcggccggctccgacccgtgccgtcgcgcgttcgtcagcccctcctgcacgatccggtaggcggtgcgccccagcaccacgggcgccccggccggcaccgtgctgtcgaaaccgacccgcatcccggccgcccgcacgctcgccaccaggtccgccacgtcggcgaggccgggctgcggcggctccgggcgcccccgcggcaccccgaccaccgcgcgcaactcctccagcgcctcgtgcgcgccggtgcggatcgccccggccgccacgcgcagctcctccggccgcagcgccgcccgtacctccagcgcgccggcgtgcagactgatcagcgacatccggtgggcgagcacgtcgtgcatctcccgggcgatccgggcccgctcggccagccgggcccgctccgcacccagatgccggtccgcctccagccgtgcggcgtgctcgcgcagcgaggtggtcagccgccggtaggcccgcacgaacgacccccagcccagcgccgccgtcgtgatcaccccgcggaccacgaagtcgacccagacgtcgtaggccgggcgctgctgcagcacgaagtacagcccgccggtggcgaggttgaccgcgcccagcgccagcaccagcgggaagcgcagccggatcgcggcggtgaacagcgccaccaggaccggtccggtggcggtcaccgacaccgccccgagcggcagcagcgccagcagcacggcgagcggatgccgccgtcggaacagcagcgcggccgcgccgagcacgccgagcgccaggtcggccggccacgggatcgccgccccggggcgcatcgcgtcgccgagcagcatcatcgtcgcgccgtagagcagcgcgagcgcgatcgcgacggcatcggcgagccggtcccggacggcggcgcgcggcccacccggatcggataccagcagcaggagcagcatgccgccgagactaggccgcgggcccggccgccggcaccctgccaaagtagggggtcgcacggttccgccggccggtgcggcgggctgctgcccgcggtcaccctggccggcatgcatgatttccgccgactgtcggttctgctcgccccggctgcctggggcgtcgtcgccgcgcgctggaccccgcacggcccgctcaccggtgccgaggccctctggtcggtgctgatcagcgccggcgtgggcttcggcgcgggccgcgtgctgcgctcgcggtggtcgattcccctgaccccgatctggtacgtgctgtgcctggagatgtcccgggtgccgccggatccgccgcacgtgagtcttctcggggtggtcaccgcgctcaccgggcgcggcgtgcacggcctgttgtcggtgttcccgatggccctcgccgcggcgtacggatgcggcttccggcgccgccgcggccggttcctggccggcggggggacgctggtgctgctgctgatcctggtcgcggtggcgatcccggcccgcacgcccggcatcccgggcggcgtcgccgagctgaccaccgtgccggcggccgggcaccgcctcaccgtgatgatccgtggccgggaccggacccggccggtcctgctgttcgtcccgggcgcgcccggcggctccgagctgggcgcgatgcgggcccacctggccgggctggaggcacacttcgtggtggccaccatggagcgccgcgggggtggtgcgtcctatgcggccctcgacccggtgtccagcgtgacgccggccgggtcggtggcggacatcctggcggtcaccgatcatctgcggtcccggtttcagcgggaccggatcgtgctgctggcccactccggcggctccctgctggcggtgttcgcggtccggcagcacccggagaagtacgcggcctacgtcggcaccgggcaggcggtcgacgtcgaggccagcgaccagatcttctacgacgacatcctggcctgggcccgcgccaccgggaaggcggacgtggtgcggaccctgcggcggcaggggcggccgccgtatcgcagcttctgggcgtacgagccgttcctgctgcacgagaacgaggcgtacgcgcagcgggccgccccgctggaggtctccggcccggagtacacgctgctgcagaaggcgcacacgctgaacgcgatcgtcgacacctgggccgcgctgtacccccgcgagcagggcatcgatctgcgccgcgacgtgcctgaactcgcggtgccggcctacttcgtgcagggcggccgggagatgcgcggcctgagcgtcctgttcgccgactggtacgcgacgctgcgcgcccccgtcaagcgcctcgtgacgatccccggcgcgggacaccgggcgatgttcgaggaaccggccgcgttcaccgccgcgctcaccacgctgctggccccgtgaccggtcaggccagcgccaggccgggatccgggtccgggtcgggggtgggcgacgggatccggtactcctcggtcagcgtggtcatcgggccgggccaggtcgcctgggccacctcgatcggtttgcgcgtctcgtcgaaggccacgtgcagcaggtgcagcaccggtgtgtccggccggatctgcaggatctccgcctcctcccggctcggctgccgggcggtgatcgtgtcggtggcggtggtgtagcggcggcccagcgcctcctcggcctcctggtagagcgggcgcccgaaagcctccgggcgttccagggtggtgccgctggtgtcggccacccggaaccaggacgcgccgagctccacggtggcctcgtcggtgcgcacgatgtgccggcgaaccagcatctcggtgccgtcgcgaaccccgaatgcgtcggtcacctccggcggcgccgcctcccggccgacgccgacgagttgctggcggtagcgagcggcgaggtcggcgtggtagccgcggtgcgcgccgtaccggccccgggacaggcggttcagccgccggcgggtgccccggacgtacgtgccggagcccggcttggtgatcaggaccccctcgacccgcagctggtcgacggcccgctgcacggtctgcttggccaccccgaacatctccgcgatgcccgggatcgacggcagacgctcacccggctgccactcaccgcggcgcacccgctcccgcagctgtgccgcgatctgccgatgcgggaactcggcggcgcccgggttgatcgtcatgcggtcctccagcacggagcggaactcagctaggttcctaggatgacctgcgggtcggtttccgcgccacccgacacgccgcgctgccaccgcgggccgttcgcggtggcagcgccggcaccaccgggcgccggcgctgccgctgaagcgtcctaccaggagccggcggtggggccggcggagccgccgcggcggcgcaggtatttctcgaactcgctggcgatctcgtcgccggtgagcggctggatgcccgcgtcaccgacgcgttcctccagttcgcggacgtattcgccgagctcggcgtcctgctcggcggcggcgtggacgcgcttctcccactcgtcggcctcctgggccagatcggccatcgggaccggcaggtcgaggacgtcctcgatgcggctgagcagggccagggtcgccttggggcagggcgggttgttggcgtagtgcgggacgtgcacccagaaggacagggcgtcgagttcggcgcgggtggcggcctcctgcaggacgccgacgatgccggtggggccgtcgtagcgggtggggaccacgttgtacttctcggcgatctcctgggccgacgcgctgccgctgatcggcaggggccgggtgtaggggacgtcggcgagcagggcgccgagcagcacgatccggttgacctcgaggctgtggcagatctccaggaccgactcgcagaaggtgcgccagcgcatgctcggttcgatgccgcggatcagcaccacgtcgcggtcgctgccgggcgggctggccacggtgaaccgggtggtgggccactcgattttgcgggtctcgccctcggccatggtgatggtggggcggctcacctggaagtcgtagaagtcctcggggtcgatgctggtgacctcacgggcctcccagacctgctcgaggtgttccacggccgcggtggaagcgtccgcagcatcgttccagccctcgaaggcggcgatggccacgggggagcggagcagcgggaggccgtcgaactcagtcatgcaacacagcctacgtgcgggcctggaaacgcacccggcggccgcgccgtggcccctccccggtcgcgagcggttttcgccatgaaggggtgcataagccagcataattcggctgtgaccagccacgttgatcaggtcctcggcccgtccgacgacacggtgtccttcatccagccgcgcgccatgttctacgtgacggtgctgtgggtggtggccgccggctgggccgcgctgctgctgctgttcctgctggtctcggtggtgttcggcgagcgtccgggtgcggcgggcatcgtggtgtacatcgaggtggcgatgatcgtcccggtgatcgtggcggcggtggtgctgctggcggtgtaccggcggctcggctggctgcacacgtcggtgcacggcatcgacttcgcggcgaccgggcgccgggcggtgcatctgccgtggtccgggatcgcgtcggtgggcctgcacgggtgggggccgttcaccgagctggtggtcaccccgatcggcgtcgactatgcgcgggtgctggacgggccggggttggcgccgcgggtccggcatcggggcggggagatgtcgtacgtcgtcgatgtgggtctgatgtcgccggggcccgaggtgctgctggccgagttgcatcgccggatcccgtccaaggtttgacggacggtgcgccgcgcgctacgttcttaaccactccgttaattaacaggggggttaagtgaccgaccggctcagcgtgatcttcgcggccctggccgatccgacgcggcgggcgatcctggcccggctcgccgagggtgaggcgaccgtgaccgagctcgccgagccgttcgacatcagcctcccggcgatctcccggcatctgaaggtgctggagaccgccggtctcatctcgcgcagccgctcggcgcagtggcgctccagccggctggaggcggcgccgctgcgcgaggcgacagcctggatggagcggtatcgccggttctgggacgagaatttcgcgcgcctcgacgcccatctcaagcgcctgcaggaggagaagccatgaccgacctcgtgatcacccggatcttcgacgcaccccgggacctcgtctaccgtgccttcgtggaccccgatcaggtggccgcgtggttcggcccggtcggctggtcggtgccgcgcgacacggtcgagatcgacgcccgtccgggcggacggcaggccttcaccatggtcaacgacgccgacccggcgacgtcctcggcggtgaacgcgaccttcgtcgaggtggtggagaacgagctgctggtcggcgaggaggacgtcagccacatcccggccttcggcgcggagaagctgaccctgcgtctggagttcttcgacgaggagggcggccggacccggctggtgctgacccagagcccgttcccggcggcgatggagaccggcgcccgcgagggctggggctccagcttcaccaagctcgacaagatcctggcctgaagcgctgccgcggcgtccgccgccggcctgcgatcgccgcggcggtacgtcggcggcgcgcgatcgaggtgccggcaggttgcccgggtggcgatcgaggtggcggtacgtcggcggcgcgcgccgcatcggctgtggcgcgcgccgtgggcgtcagtcgtgggcgatcgccccgaggacgttgaggcgggcggcgcggatcgccggcactaccgccgcgatcaccccgaccagggcggccagcaccaggtaggtgcccatccggccccagggcagcacgatcgtggtgatcccgtcgtcccggagggcgcgggccaccgccgagcccatcccggcgccgaccgcgacgccgagcagcgcgccgaagaccgagatcaccaccgcctccacggtgatcatccgcatggtttgcgcccggcccagcccgaccgcgcgcagcaggccgagttcgcgggtgcgttccagcacggacagggcgagggtgttgaccacgccgaggacggcgatcaggatggccagtccgagcagaatctggatcatcgtgatgatctggtcgaactgggcggcctggccgtcgacgaaggtcgccgcgtcggtcgccgacacctcggggctgtccgcgagcagctgcttgacctgcggcagcaccgacgagacggcgaccccgtcgtcgagccggacgaagccgaccaccggctgggtgatgccgaagtcggcgagccgggacccgggcaggatgatggagccgggcagcgtgtcgtcggcgaagatccgggtgacggtgtaggtgtgcgggtcgccccgcgagttctggatggtcacccgctgcccggtcggccagtgctcgtcggtcgcggtcgaccggctgaccgcgatctggtcgtcggccagcgcggtggccgtcgtgccgtaggcctgggcgagccggctcagatcggtggtgccggcaacgtactgccgcttgccgtcgaccgacgccacgtcgttccagaggccggcggccgcccgcaccccgccgatcgccgtgatcttctgcagaacggattgatcgtacgtcggtggccgggacccggactggtcaccgctgatcatgatctgtgccttgaggaccgtggccgcctcggcccgcagactgctcttcgccgagtccatgaccaccgtgacgccggtgaccagggcgattcccaccatcagcgcggccgcggtgatcgccgtgcggcgcgggttgcgtcccgagttgagccggcccagccggcccggcaccgaccaggcgaagatccggccgagcacactgatcaccggcctgctgagcagcggagtgagcagcgcaaccccgatgaacgagaccagcacgccgccgaggatcagccacagcgtcaccggcgcgctggtgctgacgaacaggccggtgcccagcatcgccgcgccggccgagagcaccacgccgccgaagacgctgatccgggtcagtggccggtccgggatgctgacctggtgcatcgcggcgaccggggcgatccgcgaggcacgcagcgcgggcagcaccgcggccaccacggtgaccagcaggccgacggtgaacgcgctgagcaccgcggacagcggcaccccgatcgcggcgagcgtcatgtcggcgaacctgccgaacaggccggccagcgcggcgcccacgccgacgccggcggccaggccgaggatcgaggcgatcaggccgatcatgacggcttcgatcagcaccgagccgatcacctggcggcggctggcgcccatcgcccgcagcagggcgagctcccgggtgcgctgcgccacgatgatcgagaaggtgttgaggatcaggaagatcccgacgaacagcgccaccccggcgaagccgagcaggatccggttgaagaacttcagcccctccttgatgctcgacgcgctctcgtcggccagttgccgaccggtcttcacctgatagccgtcgcccagcgcggcggccacccggtcccgcagcgcgtccggggtgaccccgtcggcggcctggacggtcaccgaggtgaacgcgccggcctgaccgaccatcagccgctgggcgaccggggtggtgaaggcgacctcctgcgccccgccgacgctgtcccggttgccggtgtaaccccagatgccgaccagggtgaactgcttcttcggggccagggtgagcacgccgacccggtcgccgagtcggagcccggccagtttcgcggtggtggcgttgaccgcgatctcgtcgtcggcctgcgggccacggccgccgcgcagctccatcgtggcgtcggtgccggtccagttctcgcccagacgcggcgggccggacgaggtgaccaccttgccgtcgccgccgatcacccgggcgccgtcggcgtcgacgcggccggtcgccgagcgtacccccgccatcgttctgatccggtcgaccgtcgcggccgggagcggcgccgcgacctgctcgccctccatccgggcgacctcgaccctgggcttcgcgctgaccgacacgtcggtggccgcgaacgcgtcggcgaagatggcgtcgaaggtgcggtcgagggtgtcggtgaccacgaacgacccggacacgaacatcacgcccagcaccacggccaggccggaaaggatcagccgtagcttgcgggcgagcaggctcttcagcgtggcgcgcagcatcagagcatcaccgggtcgccgtgcttgtcgagccgcttcatggtgtccagcaccgtctcggcggtcgggtcggtcagctcgtccacgatcgcgccgtcggccaggaagaccacccggtcggcataggcggcggcgaccgggtcgtgggtgaccatgacgatcgtctgaccgtgctcgcgcaccgaggcgcgcaggaaggccaggacctcggcgccggagcgcgagtcgagattgccggtcggctcgtccgcgaagatcacgtcggggcggcccatcagcgcccgggcgcaggcgacccgctgctgctggccgccggagagctggctggggcggtggccgagccggtcccgcaggccgaccgtgtcgatcacgacgtcccaccaccgcgggtccggcttgcgcccggcgatgtccagcggcagccggatgttctccgccgcgctcagcgtcggcagcaggttgaactgctggaagatgaacccgatccggtcccggcgcagccgggtcagcgccttgtcgccgagcttgctgatctccgtgccgccgacgtggacggtgccctcgtcgaccgtgtccaggccggccaggcagtgcatcaacgtcgacttgccgctgcccgacgggcccatgatcgccgtgaaccgggcccggccgaactcggcgctcaccccgcgcagcgcggtgacccgcgcctcgccgctgccgtagaccttccagacctgctccgcgcgcgccgccaccggctcgccggccaacgtcccagtcaccgttcgtctccccctgatcgtggacccgccggggcacgacgccccggcgggccagcccagtgtctcggcgcgaccgggcggcggcgtccgccgcacggcgtagccggggactgatatttcgctgggggagcccacttaggcaggctcagggttgtccctgagtgttggagcggggggcacccgtcgagctgtgacctccggaacactccttcggcccgcccggtccgcgccggtcacaatggctgctttgacctgggaggattcagctgagcgggacacgaccggccgcggtgctcttcgacatggacggcaccctggtcgacagcgagaaactgtggggcgtcgcgctggaggacctcgccgtccgggccggcgggcaactctccgaacgcgcccggctggccatggtcggcaccagcatgccggtcagcatggcgatcttccgggccgacctggggcagcccgaccggcccgccggacccgacgtggcctggctgaccgaccgggtcgccgagctgttcgccgccggcctcgactggcggcccggcgcccgcgaactgctccacgcggtgcgcgccgccggcatcccgaccgccctggtcacgtccacctcgcggcgtctcgccgagatcgcgctcgacaccctgggcgccttcgacgtgacggtctgcggcgacgaggtcgacagtcccaagccggacccggagccgtatctgaccgccgccacccgcctcggcgtgccgatcgcctcatgcgtcgtcatcgaggactcgccgagcggggtgaccagcgcggtcgcggccggggcggtggtcgtcgccgtcccctccgacgtcacgctgccggtcatcgccggagtccacctgcggacctccctgctggaggtcgacctcggcgggctcgcggcgctcatcccccgggtgtgaccaggccgctctcgtaggccaggacgaccgcctgggtgcggtcgcgcagccgcagcttgccgagcatgtggccgacgtgcgtcttcaccgtggtctcgctgacccgcaacgcctcggcgatctcggcgttggtgtgcccgcgggccacgtgccgcagcacctcgcgttcccggccggtcagcacccgcaggtcggcggtgaccgcggggcccggcgcggtggtggcggcgacgaaccggggcagcgcccgggccagcacccgcggcgtgatcaccgcgccgccggcggccaccgcgcggatcgccgcgaacagctcctccgggggcgcgtccttgcacaggtagccggccaccccggcgccgagcagctcgatcagctcgtcgtcggtgtcgtgctcggtcaggaccagcgtgcgcaccggcaggcgcgccgccgcgaccgcccgggccagcgcggccgggccccgccgggggagtgcggcgtcggccaccagcacgtccggtgacagccgccgggccagctccagagcctccgccccgtcaccggcctcccccgcgacgatcaactccacgtcgccgggcgcggcgacgaccgccgcgcgcaggccggcccggtgcagagcggacgaatcggccagcagcagccgcagcggccggatgcccggcccccgccgggcatccgacggtgcgtggtcaggcaacgaggccgtcccggacgggggtggtgaggcggtcgggcccctagctagctagccaggcggtcgggctcggcgtcggtgggcaggccggcggcgggcagggtggggaacggcggtggggtgccgccgaactccgggcaccgggcctggtggctgcaccagccgcagagccggctcggcttggggcggaagtcctggtcgcggcgggcgcgttcgacggcgtgggacagggcgatcagggtgcgctcgaaacgctccagctcgccggcgtcggggctgtagtcgaggacctcggcatccttgaggtagagcaggcgcaggacccgggggacgacgccgcgggtgcgccacagcaccagggcgtagaacttcagctggaacagggcgcggccctcgaacgcctcgcgcggggcgccgccggtcttgtagtcgacgacgcgcaggtcgccggccggggagacgtccagacggtcgatgtagccgcggatcagcagctcgtcgtcgccgatcatggtggagatcagggtctcccgctcggcgggctccagacgctgcgggtcctcgacggcgaagtagccggccagcagatcgcgggcaccggagaggaacgcggccagccgggccgcctcggccgccccggccggagcgtcgaccagcgcgatctgcccggcggcatcgacctcggcggcgatcgcggcgggatcccggacgagcgcgggcgactcagtggcgtgtgccacagccggcgccgggggctcggcggcgaacagcgcggtcagctcgggctcgtggccgaccaggcgctcccactccggggcgaccagggcggccgccgcctccggcgtgcgctcggcggccggcaggtcgaacaaccgctccagcaccgcgtgcaccagggtgccccgcacctggtcggcggagggctgctcgggcagcttgtcgatggtgcggaagcggaacagcagcgggcaggtcttgaagtcggcggcccgcgacggcgacagtgacggcccggccggccggtcgtccaggccggggcgcccggcggacgtggcgggggacgcgggcgccggcgcaccggggcggggctgcgggggagagaacgccgtcatgccagccaggctagggcaggggtacgacgaaaacgccggggacacccgtccccggctatcaagatccacgcgagggccggcgggtccgtagcatcaaccggatgggagacagcgcgacgcgcaggccaccggcggcgcccggtgggcggccggtgggccgggtgctgggcatcccggtgcacgcgaacggctcgatgctactgctggcgctgctggtcacggtggtttacggcaattacgcgcgcgacgagctcgggctcgcacagccctgggcgtacctcatcggcctgggttttgtggcctgtctgctgggttcggtgctgctgcatgagctggggcacgcgctgatcgcccggcgtaacggcatcggcgtgcgccggatcactctggagctgctcagcgggtggaccgagatggagcgcgacgcgcccagcccgcgggtcgacgccgccgtgtcgctggccggcccgctggtgtcgctgctgctcggcggggtggccaccggtgcggcgctggtgctgccggaggacaccgtgcccgggcagatcgccttccagctggcggtcagcaacgtgctggtggcggtcttcaacgtgctgcccgggctgccgctggacggcgggcgggcgctgcgggccgggatgtgggcgctgctcaaggaccggaaccgggcgaccgtggtggccggctgggccgggcgggtgatcgcgttcggcaccgcggtggccgtgctggtgctcttcgagctgggcctgctcaccctgttcgggatgctgttcgtgctgctggtcacgctgaccctgtggcacggtgccggccagtcgatccggctgggccggatgaccgggcggttcccgctgctcgatctgggtgtgctggcccggccgctgctgacggtgccggccggcaccccgctgggtgaggcgcagcggcgccgcgccgaggatccgcggccggacgtggtgctcgcggtcgccgacgggggcggtaatctcaccgctctggtcgatccggtcgccgccgagcgggtgccggtcgaccggcggccctgggtgagcgtggagagcgtggcccgctcccgggacgcgctgaccagcctgtcggtcgagctgaccggtgagcaggtggtccgcgcgctgcaggcccacccgggtgcgcagtacctggtgacggcaggcgaggatgtcatcggcgtcctgcgggtcgccgacgtcgcggccgtcctcgagccgcggcgggcgcaacgcacctgaatgtgcgagagcaacgcacctgaatgtgcgagagcaacgcacctcattgagcgagagaagagttcgtgaccacgatccccgcccaccgcggcccgttccgcccgggtgaccgcgtccagctcaccgaccccaaggggcggatgcacacgatcgtgctggagccgggcaaggcgttccacacccaccgcggcgcgctggagcacgaccagctcatcggcctggccgacggcagtgtgatcgccgccaccagcggcacccagtatctggcgctgcggccgctgctcagcgactacgtgctcagcatgccgcgcggtgcgcaggtgatctatccgaaggacgcggcgcagatcgtcgcgatgggtgacgtcttccccggggcgaaggtgctcgaggccggcgccggctccggcgcgctgacctgttcgctgctgcgggccgtcggcgagtccggcgaggtgcacagctacgagctgcgcccggacttcgcggcgatcgcccgcaagaacgtcgaggcgttcttcggcggcccgcacccggcgtggcacctgcacgagggcgatgtggccggcaacgagatcggcggattcgaccggatcgtgctggacatgctgaccccgtgggaggcgctcgacatggtggagcgctcgctgatccccggcggggtcttcatcggttacgtggcgaccaccccgcagctgtccgagctggtcgaggcgctgcgcgagcggggtggctggaccgagccgcgggcctgggagtcgctgatccgcgactggcacgccgagggcctggcggtccgcccggaccaccggatgatcgcgcacaccgcgttcctggtgtcctcgcgcaagctggcaccgggcgtgaccgcgccggcgcgccgccgcaagccgagcaagggcgccgaggcgtacgcgctgcgccgggcggcgatggcggcgctggccgccgagagcaaggagtctgcggacacctccggggagtgaccacgatcgccgcgtcgggtaggttcctcggtggcgtcgatgggaggacgaaggggtgggcgcgatgagttctccgccgttcggcggcagcaacgagatgccggcggtgttcccggactggtcgccctaccccgacctggattcggcggcccgtgcctacctgcgcgaccccgaggtggccctggaggcgctgttcggcgtcctgcgtggcgcctcggtgctctgcttcaccctggagcgcttcgtcaacgaggtgaacggggtgtggcaggaggtcgtcgtctgcgacggcagccgcctggtgctctggcacggcgaggacgtggcgcccggggacggcccggccgggtcgatgacctcgtcgctgcgcgtggtgccgctgtcgacgatcaccgaggtgggctgccggcggcggctcacccgcacctcgaccgggcaggcccgggtcgacagcatcgacgtctacctgctgctgagctcggtcgacgacgctctgccgccacccgggttggccgaggaggagggccgggcgccgctgcgccacgacgcgctgcgcttcggtaagaccctcgacgacggcgggccggggcagatcgcccggttggaggaattctcccgggtcgtcgcctccctggtgggccgccccaccctctgatcaggcggcgtccgggccggcgacctccacgtcgtcggccgtccgcacgacgtggatgcagtcgcccgggcactccttggcggagtcgatgacttccaggatcagattgcggggtacgccggtgcgcacgcccgggttctgcaacaacgcgccggaatcggatttcacgtacgcgaggccgtcgatgtccaactcgaagacctccggcgcgtattggacacagagtccgtcaccggtacacaagtcctgatcgatccagacctgcagctcatcagtgtctgctgacactcctacctcccacaaccggttgcggcagatggtatgcgaatgctggccgaccggctcaccggcggtgggcccaatcgatcaagagtcggtgacgagggtgttgcatagggggaaatccgccccgcaacagctagtgttgacccaagacgttcgagccccccggggaggtgggacgtggcacgtagcgacgaagcggactcccgcgccgcacgatgggagaaagaggccaacgatctctccagccaggtcgcgttcctgcaagaggaactcgccctggttcggcggaagttgaccgagagcccccgacacgtccggcagctcgaggaacggcttgcggcgacgcaggcgcagctctcccgagtgaccgagaacaatgagcggctcgtggcgaccctcaaggaagcccgcgcccagatcgtcactctcaaggaagagattgaccggctcgcccagccgcccagcggctacggcgttttcctgtcggcccacgaggacggcacggtggacgtgttcaccggtggccgcaaactgcgggtggcggtctcgccgtcactcgccgcggacgagctgcagcggggccaggaggtcctgctcaacgatgcgctgaacgtggtggacgcgttcggtttcgagcgcaccggtgaggtcgtcctgctcaaggaggtcctggacaacccgggtggcggcaccgccgaccgggccctggtggtctcccacgccgacgaggagcggatcgtcttcctcgccgagtcgctggagatcgccaagctgcgcgccggcgactcgctgatgatcgagccccgttcggcgtacgcatatgagcggatccccaagagcgaggtcgaggagctcgtcctggaggaggtccccgacgtcgactacaccgacatcggcggcctgcactcgcagatcgagcagatccgcgacgcggtggagctgcccttcctgcacgccgacctgttccgggagcaccagctgcgcccgccgaagggcatcctgctctacggcccgcccggctgtggcaagaccctgatcgccaaggcggtggccaactcgctggccaagaagatcgccgagcgccgtggtgaggagaagcacaccagctacttcctcaacatcaagggcccggaactgctgaacaagtacgtgggtgagaccgagcggcacatccgcctggtcttccagcgggcccgggagaaggccggcgagggcaccccggtgatcgtgttcttcgacgagatggactcgatcttccggacccggggctccggtgtctccagcgacgtggagaacaccatcgttccccagctgctcagcgagatcgacggtgtcgagggcctggagaacgtcatcgtcatcggcgcctccaaccgggaagacatgatcgacccggcgatcctgcgccccggccgtctcgacgtgaagatcaagatcgagcgtccggacgccgaggcggccaaggacatcttcgccaagtacatcctgtccgacctgccgctgtccgaggacgacctcggcgagcacggcgggaaccgggaggccacggtcgccgcgatgatcgaggcggtcgtcctgcggatgtacaccgagtccgaggagaaccgtttcctcgaggtcacctacgccaacggtgacaaggaggtcctgtacttcaaggacttcaactccggcgcgatgatccagaacatcgtcgaccgcggcaagaagatggcgatcaaggagttcctcacctccgggaccaagggcctgcgcctgcagcacctgctggacagctgcgtcgacgagttccgggagaacgaggacctgccgaacaccacgaacccggacgactgggcccggatctccggcaagaagggcgagcggatcgtctacatccgcacgctcgtctccggcggtaagggcaccgaggccggccgttcgatcgaaacagcgagcaataccggtcagtatctgtaacgagtagtcacgcgaaagggtggcgggggagacctcgccaccctgcacgctatcctcgcccgcgtgacccgatcccgcctgacctggctcgatgcccttcggggtttcgccgccgcggtcgtcgcgctcttccacctcagcccgtccgtaatcggtctcgatcggcacgcggcgatgcagcagcacttcgacctcggccgctacggcgtgctgctgttcttcctcgtcagtggatacgtcattccgatgtcgctggagcggcacgggtcactgcggcggttctggatcgggcgggtcttccgcatctaccccgcctacctgctggcgatcggggccgggctgctggtcgccggggcgggcctgcaggagctgcacggcagcctgtactcgaacaccttcgcgtcggtcctcgggcacgccacgatgatgcaggacctgctcggcctgcgcggcgtggtgcgtccgatctggaccctggcgtacgagatggtcttctacctaatcgtggccggcctcttcgtctggggccggcagcgggccagcgcctggtgggccggcggtctggcgctgctcgcgctggtggccggccgccggctgccggacggggtgttcgccgccgacttccacgaccgccgcatcaccgccgtcgtgctcaccgtgatcctggtggccagcatcgccgcgtacctcagcggtgcccgcccggtgatgctcgccgccggtctggtcggcgtggccatggtgctgctgccgatgctcaacggccagcccacccggtatgccaccccgggcgcctccagcaccgccatcctgctgctcgcggtgatgttcgccggtaccgtgatctaccgcgcgcagcaccgcgaactccaccggtgggtggccggggccacgctgaccctggtcctcgtcgtccaggcggtcaatcagtggctgctggacggtacccagctggtgcgcaacatcagcgtcgccggcgcggtggccggcaccttcgcggtcgccttcctgatgcgccaccgcgccgtcccgggcttcctcacctggctcggcgtggtcagctattcggtctacctcttgcacatgccggtgctcgcggtcgtcacccggctgctcaacggtcacccgctgccgctgttcgcggccttcgtcgtggccaccctggcggccgcctggacctcctaccacctggtcgaactccccgggcaggaactcggccggcgggtccagcgccgcctggacgccctcctgggccccgacacgccgcggaccgccacgaccacggaaggtggcacgccgagcacgggcagcttcggtatgcgccatgagagcgtctaggctcgatacatgagcacgcttggcttcgtggcggacagggtggtcgcatgagcgttcgacggattatgggcaccgaggtcgagtacggcatttcggtgcccggccagcccggcgccaacccgatggtcacctcctcgcaggtcgtcaacgcctacggcgcccggccggaactcaaccgtggccagcgcgcccgctgggactacgaggaggagtccccgctgcgtgacgcccgtgggttcacctactccggcgccgcctacgaccccgccgaagccctcgccgacgaggatctcggcctggccaacgtgatactgaccaacggcgcccggctctacgtcgaccacgcccacccggagtacagcactccggagtgcaccaacccgctcgacgtggtcaagtgggacaaggccggcgagcgggtgatggccgaggcgtcccggcgggccgccaccatccccggcgcccaccgcatccagctgtacaagaacaacaccgacaacaagggcgcgtcgtacgggtcgcacgagaactacctgatgcgccggcagaccgcgttcgccgacatcgtcgcccacctcaccccgttcttcgtcacccggcagatcttctgcggggtcggccgggtcggcctcggccaggacggcagcggcgccggtttccagatctcgtcgcgcgccgacttcttcgaggtcgaggtcggcctggagaccaccctcaagcggccgatcatcaacacccgcgacgagccgcacgccgacgccgacaagtaccgccggctgcacgtcatcatcggcgacgcgaacctctcggagatcgcgtcgtacctgaagatgggcaccaccgcgctggtcctcaacatgatcgaggagaaggtcttcaccggcgagctcggcatcgccgacccggtcagcgagctgcgcgcggtcagccacgaccccaccctcaagcacctgatgcggctgcgtgacggccgccggctcaccgcgctcgacctgcagtgggcgtactacgagcgggccaaggcgttcgtcgacgagcgctacggcgccgacgccgacgagcagaccaccgacgtgctcaaccggtgggaggacgcgctcgacaagctcggccgtgacccgatgctctgctccgacactctggactgggtggccaagctgcggctgctggagggttaccgcgaccgggagaacctcacctgggcgtcgccgaaactgcagctggtcgacctgcagtacgccgacgtgcgcccggagaaggggctgtaccaccggctggtggcgcgcggttcgatgaagacgctgctcgacccggacgacacgcagcgcgcgatgtacgacccgccggaggacacccgggcctacttccgcggccgctgcctcgcgcagtacgcctccgaagtggtcgccgccagctgggactcggtgatcttcgacgtcggacgcgagtcgctggtgcgggtgccgatgatggagcccgagcgcggcaccaggaagcacgtgggcagcctcttcgacacctgtgagagcgcgaaggatctgctggaagtgatcacgagtcggtaataaaacacccgttgcggcggggcgtttcgtcaccgggtcgaggtaggttttcggtacccgatgttgcatcgggggcttggcagtcggctggctttgaagggggacatccatggcaacccgagacaccggtggtcagtcgcagagcgggcgtggctccagcgactccgagatcgaggacgtcaccgtcgaagccaaccctgaggtggcggagcggcacgcggaaatcaccgaggacgtcgacgacctgctggacgagatcgactccgtcctggaggagaacgccgaggagttcgtccgcggctatgtccaaaagggcggccagtgacgtatatgtccgattagtgacctgccgggcgcccgcatgggcgcccggcgagcatttacggacaccccgcaagatcgggataatgagcttcaacccgcagcggcggcaattccgcgccgctgcgatcacgtacctgaaaggaaccacgtggcgacgggttttgatccatccgggcggctaccggatatctttctcaacacggggacgtcctccttcacgcagttcctgagtgcggcggcccccgaactcctgcccgggcggcgcccgcttccgccggggctgtccgcgggtgacgtggcgccgcacggcaccacgatcatcgcgatcgcgaccgccgacggggtcgtgatggccggtgaccgccgggcgaccatgggcaacctgatcgccagtcgggacatccgcaaggtgcaccccgccgactcgtactcactgatcggcatcgccggcacggccggcatcggcatcgagctgatccgcctgttccaggtcgagctggagcactacgagaagaccgagggcgcgatgctctcgctcgacggtaaggcgaaccggctggccgcgatggtccgcggcaacctgggcgcggcgatgcagggcctggccgtggtcccgctgttcgccggcttcgacctcgccccggccgactcctcgcgggccgggcggatcttcagcttcgacgtggccggcggcctctacgaggagaccggctacgaggcgatcggctccggttcgctgttcgccaagtcggcgctgaagaagaagtaccgcgcgggcgtcagcaccgaggaggccatccggctcgcggtcgaggcgctctacgacgccgccgacgacgacaccgcgaccggcggccccgacctcacccgcaagatctacccggtggtgatgaccgcgacggccaacggcacggtgcggctcagcgacgaggagatcaccacggtggccgagcaggtcgtctccggacgcatggagaacccgggcggttgagccgtctgacgcgagagaaggagtagccacccgtggccatgcagttctacgcatcgcccgagcaggtccagcgggaccgctcggagtacgcccgcaagggcatcgcccgcggccgctcggccgtggtgctgtcgtacgagggcggcatcctgctggtcgccgagaacatcaccaccctgcgcaagatcagcgagatctacgaccggatcgcgttcgccgcggtggggcgctacaacgagttcgagagcctgcgccgggccggcgtgcggatggccgacatgaccggcctgacctacgaccggcgcgatgtgaccgggcgggcgctggccaacgcgtacacccagaccctgggtgcgatcttctcggagacccagaagccgtacgaggtggagatctgcatcgcgcaggtcggcgccaccccggaacaggacgagctgtaccggatcatgtacgacggctccgccctggacgagcccggcttcatggcgatgggcggccaggccgaggcgatcgcgaacgtgctgcgcgagcggcacgacgtcgcggccgatctgccgaccgcgctggcgctggccgccgaggcgctgggcagcgtcggcggggagaacggcgcgacccgcaccctcgggcccaagcagctcgaggtggcggtgctggaccgccgccgggtcgggcggacgttccggcggatcgccgacgcggcgctgaccacgctgctggggcacgaggccgtgccggacgcggatctcggggagaccgacgccgccccgccggcgccggccgacagcaaacccaccgagtcggccgcttcggagagtaccgagggctgagcggttcgtgagcgggcgcggcgaaatgccgcgcccgccgcaaacatgccgcgccgcggtgaagatccccgaaaacccgattactggggcccttcggtggctgccaatgcgccccggatgcggctagtgtcttgtcatggaacggcgaattttcggcctcgagaccgagtacggagtcacgtgcacctatcgggggcagcggcggctgtcgccggacgaggtggcccgctacctgttccgccgcgtggtgtcctggggacgcagcagcaacgtcttcctccgcaacggcgcccgcctctacctcgacgtcggttcccacccggagtacgcgacacccgaatgtgactcggtcaccgacctggtcgcccacgaccgggccggcgagcggatcctggaaggcctgctcgtcgacgcggagaagcgtctgcacgacgagggcatcgcgggcgagatctacctgttcaagaacaacaccgactcggccggcaactcgtacggctgccacgagaattacctggtcagtcgccacggcgagttcggtcgcctggccgacgtgctgatcccgttcctggtcacccgccagctgatctgcggtgccggcaaggtgctgcagaccccgcgcggcgccgtcttctgcctctcgcagcgcgccgagcacatctgggagggcgtctccagcgccaccacgcgcagccgcccgatcatcaacacccgcgacgagccgcacgccgacgccgagcgctaccgccgcctgcacgtcatcgtcggcgactccaacatgaacgaggtcaccaccctgctcaaggtgggcagcgccgacatcgtgctgcgcatgatcgaggccggcgtggtgatgcgcgacctgtcgctggaaaacccgatccgcgccatccgcgaggtcagccacgacgtcaccggccgccgcaagatccgcctggcgaacaacaaggaggtctccgcgctggaaatccagcaggagtacctggcgaaggcgaccgagttcgtcgagcgccgcggcggcgacccggtcgccaagcgcgtcgtcgaactgtggggccgcgtcctcaacgccatcgaaaccgagaacctcgacccggtcgcccgcgagatcgactgggtctcgaaataccggctgatcgagcgctatcaggcgaaacacgacatcccgatgtcgcatccgcggatcgcccagctcgacctcgcctaccacgacgtgcgccgcggccggggcctctacgccctcatggagaaacgcaagcaggtcgaccggatcgccaacgacctgcagatcttcgaggccaaggaaaccccgccgcagaccacccgcgcccgcctgcgcggcgagttcatcaaacacgcccaggacaagcggcgcgacttcaccgtcgactgggtgcatctgaagctgaacgaccaggcgcagcggaccgtgctgtgcaaggacccgttccgcgcctacgacgaacgagtggaaagactcatcgccagcatgtgagcggaggcatcgtcggcggatgggccgcgagggttcggccggccggtgggcgatcctcgcggctgcgccggcgaccctcgtcggatcgccggtggtgccggtcggtcttcggtgaggcgctggtgtttccggctcctgctgcggtgccgggtgtgttggcggctcctgcgggggtgcccggtgtgttggcggctgtcgccgggtgctgggggtggtggcggctcctgccgcggtgccgggtgtgatggcggctctcgccgcggcgaggctgttcgttggcaggtgagcgggtcgcgttaggcttgcccggttatgacatcgatcaactccggccagcccgatcccgaggatgtgcgccgcctcaaccgtgccgaccgtcgtcgggagcggatccgccaacaggtgcagcaggcgcggcacggccgcaaactgatcccgacgtggctgatggcggcggtattggcgctctttctggccggctgggtgtatctgatcgtcaccaaatagggtgcggatcggtcgtcgttcgcatcgccgtgcaaagacgcagaacgatccccgcacccttccgcatcgtcggttgggcgcggtgggagcaaaccgccgagcgcaacaccgatcccgtgccccgcgtccggcttcgaccgtcctgcgcccgcgcttgcggtccgcgcccccgcgtctagctagctagcccccgcgtccgcgcttgcggtccttgccctcccgtgtctgcgggtctggtgcggatgcgtcccgcggtgaccgtgcggggcccccgcgcccgcgcttgaggtcagctcggcggcggtctcgcgggccggtggatcgcttctcgcggttaccccgtccggaaatgtcgggtgtgtggcctctggggatgggcgcggcgggttgtcacagcggaggccgccggtagggaagggggtgcgggatcggccggtttgcgagaggctccgggctatgaccgagattctggggccgggcatcgaggactacctgctggcgcacagcacgccggccgatgagctgctgcgggagttggcggcggagaccagggcgtcgcttccgccggattatgccggcatgcaggtctccgcggacgagggcgccctgctcaccatgctggtgcagctgaccggcgtggattatgccgtcgaggtgggcacgttcaccgggttctcgtcgatctgtatcgcgcgcgggttgcggcccggtgggcggctgctggcctgtgacgtgtccgcggagtggacgaggatcgccggcggctactgggagcgggccgggctgcgggaccggatcgagttgcggctcgggccggcggtggagacgctgcgtgcgctcccggccgatccggtgatcgacttcgggttcatcgacgccgacaagatcaactacccggcctactacgaggaactggtcacccggctgcgtcccggcgggctgctcgccctcgacaacgtcctgcgtgacggccgggtgctgcacccgaccgatccggccgaccgcgccatcgcgcagctcaacgaccggatcgtcggcgacgaccgggtcagttcggtgatgctgccggtccgcgacggcgtaaccctggtccgcaagcgcgactgaacccaccgcgagctgcgccccgcgacgccggccggtgcggcgccgtccagcaccggctcgggccaccgccggctcgcgtggcgagccgtgcgcgacgggccggccgactcccgggggaaaacgggattgaacccgttccgcaaccgggatggcgtctcctgattcgggtgatcattggtcgggggcggttcgcggtcgccgcggtggtggcgatcgtggcgtaccagttcctgccggcggtcggctggctgaccgtctgctggcaggtggcgatcggctgggccagcgccgccgtgatcgtggccggggcccgccggcagacgtgccgggatcgggcgccgtggtggtgcttcgccgccggcgtgttcagcaatgcgaccggcatcctggtcgccaaggtcagcgcggtgtggtggaacctggcggatctgccgacccgttcttcctcgggctgtatccggcatgcgcggccgggatcgccctgctgatccgccgccgcgacgagtggcgcaacgggaccgccctggtcgacgcggccaccatcacgatcgggttcgggctgctggcctgggtgttcgtgatcgagccggcgcatggggacattcagatggaccggctggcgtacggcacccaggtcgcctatccgatcggtgatctgctgctgatcgcgatgatgacccggctggtgcgcggccgcggtgcccgggggccggcgctggccgcgatggtcgcggcgctgggggccctgctggtcggcgacagctcgtgggtgatcatggacaatctgggcggcgccgagaagtggctggggctgctgccgtggctgggccgcgccctggagtcggtgttcgtgaccgcgttcgcgctgttcgcggtagccgccctggacccgggcgcggggcggctggcggagccggcgcaggagcggtcggcccggctcggcccgggcctgctggccctgctgaccggcgcttcgctgatcgcccccgggttgctggccggccagttgcacagcgggtcggtgaagaacggctggagcatcgtgctctgctccaccaccctgttcctgctggtcgtggtgcgcatggcgggtctggtgcgggaggtggagcgacaggcccggcaggtgcgggacctggcccgctcggatgagctgaccggtctgccgaaccgccgggcgtggaacgacgaactgccccgcgccctggaacgggcccgccgcgatcaccagccggtggtcgtcgcgatcgtcgacctggaccatttcaagcggttcaacgacacgtacggtcatccggccggtgaccggctgttgaaggcggccagcgcggcctggcacgagacgctgcgcaaggcggatctgctcgcccgctacggcggcgaggagttcgtggtgctgctgcccggctcggatgcggcgcacgggcacggcgcgttgagccggatgctcgccgccaccccgcaggggcagaccttctccgccggtctggcggtctgggacggccaggagacctcggacgagctgttgcagcgcgccgaccaggccctctacctggccaaggagcggggccgcaaccggatcgagatgccggccgccgcgtgacccgcggtcagcgccggtgccgcgggcgccgccggtgacccgccgcatggtccgcggcctcctcgttgcgcatcgccacggccagcagcaccgcgacggccacaccggtggccagcactttgcggtgttcgccgcggccgtgccagtagaccggcaggccgatccaccggatcagaagccggggtagcccgcgcaccgaggacggcggcaccggcgtcgagtcctcggtcgcgttcgcgtcgcccttggtgatcaggctgccgtcggcggtgcgccgcacgacccggtgcagcagcaggtgcccggggcgggcggggttgtcgacgaggaccgccatgccgggtctcatcttcgcggcgctgatcgggccggcgatcgccacgtcgccggagtggatcttcgggagcatcgagccggacaccacgaccacgctggtccagccgaagacgacgggcagcagcgaccagagcaccgccaccgcgcaggtgcccagcaggatccgggcgagcacgctcgcgatgaaccaggcccaggcacgggcttccgccatccctcaagtgtccggccggacgtccgatcgggagcggcgttccgctggagagccgcagggagtcgccatgtcgcagaccgatgccgccgagcgccgccgtcgccggcgtcgccggttctccgggctcgccgtgccgttgagcatcctgctggggtcgatgctggtctggcagtcgtccgagtcggcgtacacgacgacctcgtcgacgctgaacaacacctggaccgcggtgagcgtggcgctgaccaacagccaggtggcgtcggcgccgttcaccgtgtcggtcgcggtgccggacgcctcggcgagttcgatcacgcttgccgggttctcgcccagcagtgtgcggaccggtggtcagatgtgcatcatggtcgactaccagaccggtgcgccggcgcacatccggatgcggatcgacgacaacgcggacgccctgtccgcggcgctggagatggtcatcgacgagggcaccggcgcgacgaacgcggcatgctcgggtttcacgtccaacggcacctacgtgtacgggacgggtgcggccagcaccgcgaaggtcagcggcctgccgacgacgtggggcaccagcaccgcgggggagtggaccgcggccacggcggcgcagctgtggtacagggtgacctggctgctgccctcgaacgcgctggcggcgacctccggcaccagtgccgacttcaagttccagtgggaggcgcagccctactgatgcccggggtacgacggtcccgaccccgccatcggcgtcaccttcggtggcaccggcggtggtggccggccgccgtcctggtgatcgtcacggccgccgccctgccggtcaccggcgccgggtacacgggcaccacgtcgaccccggtgaacacgttcaccgcgggaacggtggtggtctcggcgtccgccccggccggcagggttttcgcgatcaccaacgcgatccccggcacggtcggtacgacgtgtgtgatcaccgcgtacaccggaaccgccccggcgaccgtgaagatgtacttcacctcggtcgccgggacgctcggcgcctacctggtggcccaggtgcagagcggcaccggggcgcagaccgactgctcggatttcggctcgtccgccacgctgtacaacgggagcgcgccggccaccggcggccccaccctgggcccgtatctggccgcgcacaccggctggtccagcggcgacggcgcgtgggcggtgtccgggccggccacccgggcatggcggttcgacctcctgctgccgaacaccgccggtgacgccgcggccgggctggggctcaccttcaccgccacctgggaggcgcagacctgattcgtcggtccgtcgcggctcagcagtctcccgcctccgaccgatgggaccagggaggatgccggggggaagcatggcgacgtggagccggcgccggcgggtggccgcggtcctgttcgccggcaccctgctggtggcgatgccgctggcctggcggccggtggccgcccagtacacggccaccaccgcggtcccggccacggtcgccgcctcggcgggtttccccggcctgccgcagctggtcaccgacggcgggccgctgttctaccaccggggcgaggagagccagaccggcgcgctcagctcgaccgccgtggactcgtccggcaacggccaggacggcgcgtacgcgaacagcacgaacggtccgtcgctgtggtggccgatggacgacggcccggcggccacaaggtaccgcgacctctccggcaccaccgacaccggcaagcccaccggtaccccgatgacggtcaccaacacgaccgggccgaccggcggcgcgtacatgctcggggcctcgaccgcgagctgttgtgcccaggcgacgctctcctcggtgctgtcgccgttccgggcggaccgggacttcaccgtcgcgctgtgggtcgacatcggcgacaccgcgccggctgccgggagccggttctccgccttccacatgaccaacagctcctaccggcgcagtgacgtggcgctgctggtggacaacagcgcgtcctgcgcgatggcaccgtgctgggcgttcaccatggccaaggatccgaacagcaccacggtgaccggctgggacaccgcctacggttcggccgccgcggtgaacacctggacccacctgaccgcggtcttcgtcgccgcgacgggcacgatgagcctgtacgtcaacggcgtcgccccgcccgcgaccgccacgcacaccgtcccggccgacgccgccaccgaccggaacgtgggtttcggccggtaccgtaccggcgccggtaccggcaactgggccggctacggcggccggaacaccggcatcggcatgatcatcggcgaggcgcgcacctggcggcgcgcgctgagcgcggccgaggtggccgagctgccggtccgggccaccagccgctggaccttcgacgaggccaccggcacgacacccgggtacaccaccgcgtcggcgagcaccggcacaccgtcggtgaccggctcgtcgaccgccggggtgacggccggcgcggcggccgccctgacgaccggccgcaccggtaacgcgctgaccatcgccacggccggcgtgaacggctacgtgcagggaccctcggcgcaggtgaccaccagcggcagcttctccgtggcggcctgggtcaggctcaccgacacgagcgcggaccgcacgatcgtctcgcagaacggggtgctcggcaccgccttcacgctcggctacgacagcaccgccaaccgctggcggatgcgctggtggccgagcgacgccgcggtggtcacgccgaagagcacggtcagcgcggcggcgccggtgctgaaccagtggacccacgtcgccggggtctacgaggcgggaaaggagatccggctgtacgtcgacggccgctccagtggcaccgccacccccgcgaccacggccgcctggccgtccctcggggcgacccagatcggccgccgggtggtcggcggcgccaccgccgagggctggcagggtcagatcgacgacctgcgcgtctacaacggctacccggtggtgtccaccacgatgcggcagctggtcggcagcgtcgaggtcgaggagaccggtggtctggccggcacgcgtccgctgcacgcgaacaccaccgcgatggccttcggcggttcgtccagcggcgggaacggccggttcgccgccgcggtggccggtcccgccttcaccgaggagtgcctgatccgggtggcgagcggcgagaccggggtgatcggcgggttcgccgacaccgacgaccagctcgacagcaccgtgaccgaccggctgatgtacgtcgacaccaccggcagggtgcggttcggcgtgctcggcgcgggcgtcccggtcaccgtggtcagtgcggcggcggtcgacgacgggacgtggcaccacgtgctggccagcgtcggcgcggccggtctgaagctctacgtcgacggcgtcaaggtgaccggcacggccgtcaccgcggccgcctccacgaccggctactggcgctggggcggggtggcgatgctgccgctgaacggctggccgtccgccccgtcgaatccctacctgaccggcacgatcgacgagttcgcggtgtacgaccggcagctgaccgatcaggaggacctttggcgggtgtacgcggactacctggagtgaggcggcggcggatcgccggcctggcggtgccgctgagcatcctgctgggctcggtgctggtctggcggtcgtcgacatcggcctacagcgcgaccacctcgacgccgaacaacacctggaccgcggtcagcgtgacgctgaccaacagccaggtggcgacggcgccgttcaccgtgccggtcgcggtgccggacgccacggcgagctcgatcacgctggccggcttcgcgcccagcagcacccgcaccggcgggcaggcgtgcatcatggtcgattaccagaccgctgcgccggcgcacatccggatgcggatcgacgacaacgcggacgccctgtccgcggcgctggagatggtcatcgacgagggcaccggggcgacgaacgcggcgtgcgcgggcttcaccgccaacggcaccttcgtgtacgggacgggcacggccagcaccgccaaggtcagcggcctgccgatcacctgggggaccagcgcaccgggggagtggacgacggccacggccgcccagctgtggtaccgggtgacctggctgctgccgtccaacgcgctggccgccacctccggcaccagcgccgacttccggttcgtctgggaggcgcagccctactgatcggcgccgagcagggcggcggcgtgccggccggccgcggcggcggccaggaagtacgcgtggtcccggtccagcccgcggcccatcgtcgacagcggcaccggcgacgcccgcagcgccgcgtccaggccgccggtgggcacctcgacgatccggtgccgctcggcgagcggcgcgatcgaggcggccagggccgccggcagaccctcgggcaccggcaggtccgctcggatcagggcgactttcccgtacgccgtgagactgtgatgggacaccccgcggtgccgttcccgcccgtcgccgtcggagatccgcagcgacccgaccggccgcccgccgagcacaccgatcgcgttgaccgcctcgcccagcgccaccccggagaacccccaggtggtgccggtacccaggttgcccgggccctgcgcgacgacggtcacgtcggcgcgcagcacgtgccgggcggccagcagcccggtgtgcacggtgctcgcctccaggtcgccgccgaaggcctgtccggtcgtcaccgtcccggccaggtgcccggtgagcccgtccagggtccgggagaaccacgcgggcagcgcgccgccgtcggtcatcacgtacgccacccgggcgtccggccggtccgcgcggaccccggccaggatcgccggcagcgcggagtgcaggtcggcggtgaccaccggcatcgcctcgagcgactcggcggctgccagcaccgcccggtgcggggaggcctcctcgtcgaccccgagcaggatcggctgcagcggcgtgtaccgcgccttcaccaggtgacccgcgtcgcgggtggtgccgtcgtcggccgggtccgcgggcaaccggtcgggcagcgcgacgaccagcgcgtaccccccggtgcccaggcccatcaccagcgcgccgacgttgagcagcacccggtcgccgggctccggcgagccgaccagctccgggtaggccagcgcgcgcacgccgccgccgtcgcacagcacgtccagctcgatggcgccgcgccagcgtcgccgcaccgaggacaccgttccggaccgccagcgcaccatgagccggaaccctatcggtccaggccaccgtcgatgtggtcgcgtcccggaacgccgcgggtggggtccaggaagacgtaccggatctccggatagcggtcgcgcagccggcgttcggcctcgtccgaggcggcctcgatgtcccggcccggcacctcgtcgtcgaagtcgaccttcgccgcgaccaggatgtcgcccggcccgatctgcatggtgaacagcgtcggcacgccggtcaccaccgggatggaccgcagatcggccgcgatctggttgtgcatccggcgcggcaccgcccgcccgaccagcagcgacacgttggtccgggccagcaccgaggcgaccaccagcagcagggcgccgatcagcacggaggccgacccgtcccacacctcactgccggtgagctgggtcagcgccagcccggcggcggccagcagcagcccgatcagggccgccgcgtcctcgaagaagaccgccttgaccgtggtgtccgaggtgagccgcaggaagcgctgcgggctgacgttccaccggcgggactgctcgcgcacctggcggcgggccttcaggaacgaggatccctcggcgacgaacgagatcgccagcacgacgtacgaccacaggtagtcgccggcgtccgcgccgctgacgatggtgctgatcccgtggtagatggagaagccggcaccgcccacgaaggtgaacagcgaggcgatgaacgcccagacgtagctctccttgccgtacccgaacgggtgttcctcgtccgccggttttccgccccggcgcagcgcgacgtagaggaagatctcggtgaccgtgtcggcgaacgagtgcgccgcctcggacagcatcgccgccgagccggacaacagcccggcgaccagcttggcgaccgcgatgaccaggttcgccagcagcgccagcagcaccgtcccgacgctttcggtcgcggcctgcggctcgttgtcgggcagaccggtcggtgcggtctcgggctcgggtgcgatcgtcacgtcgtccttggttccccgccccgctcgcgtttaacggtctggacacccgggctgctaggtttcctgtcgtgtcgcgcactcgaaccgagcgcctggtgaacctggtgatctgcctgctgtccacgcgacggttcctgaccgccgcgcagatcgccctgaccgtgcccggttacgagcacgacccctcggatccccgggaccacgaagccttccagcgcaagttcgagcgggacaaggccgagttgcgcgagctgggcgtgccgctggagaccggcaccgcgagcatcttcgaccaggagcccggatatcggatcgcccagcgggagtacgcgctgcccgacatcctgctcgaacccgacgaggccgccgcggtcggcatcgccgcccggctgtggcagcacgccgggctggccgccgccgcctcgtccggcctggccaagctgcgtgccgccggggtcgaggtggacccgcaggccaccctgggcgtcgagccggtggtcacggtcgacccggcgttcggcccgctcaccgcggccgcccgggcccgccgcgcggtccagttcaaataccgggtgcccgcggtcgacgagcccagcgtccggcgcctggagccgtggggcgtggtctgctggcgcggccggtggtacgtggtgggccacgaccgggaccgcaacgccgcccgctgcttccggctgtcccggatcgtcggcgacgtgcgcgccgtcggccgcccggaggccttcaccccgcccgccgacgccgacctgatcagccacgtggcccacagcaccgggccgatcgcgcgcaccggccgcgccaccgtcaccgtgcgtcccggccgggccgccgggctgcgccggctggccagcgaggtcactcccggtccggacggggacagattgactatttcgtacggcgatccggactggctcgcgtcccggatcgcggggtacgggccggacgcccgcgcggacggcccgccggagttgcgggacgcggtcatccagcagctcaaggagctcaccacccggtacgaccgggacgtcccggcggtcgcccgatgaccgccccgcgcaccccgtccgccgaccggctcggccgcctgctcaacctggtgccctacctgctggcccgccccggcatcctgatcgccgaggccgccgacgacctgggcgtcaccgccaagcagctgcgcgaggacctggagctgctctgggtctgcgggctgcccggttacggccccggcgacctgatcgacatggcgttcgacggcgaccgggtgacgatcagccacgacgccggcatcgacaagccgctgcggctcaatcaggacgaggcgctcgccctggtggtggcgctgcggatgcttgccgagacaccgggcatcggctcgcgggacgcgatcgagcgcgccctcgccaagatcgagagcgcggccggtgacctggcggacgccccggtcgccgtgaaactcccggccaaccaggagaagctcgccaaggtccgggccgcggtcgactccgggcacgcgctgcggctcacctactacacggcggcccgcgacgagaccaccgagcgggtcgtcgacccgatgcggatgctgaccgtcggcaccttcgcctacctggaggcctggtgccgccgggccgaggcgacccggatgttccggatcgaccggatcgacgcgttcaccgagctcgacgagccggcccggccgccggtcgaggcggtcccgcacgacgtcacgcacggcgtcttccagcccggcccggagctgcccctggtcaccctgcgggtgggccgcggcggccggtggatcaccgagtactacccggtcgagcaggtgcagcgggagcccggcgagtggctggtcacgatgcgggtcaccgacctggtctgggcccgccgcttcctggtcggccgcgccgacgtcaccgtggtcggcccacccgagctggtcgagcagatccgtgacgccgcgcacgaggccctcgaccagtacgccgcgccgcactcactcgcggcggaccgggccccggccggatagggtggcgccgtgctgatgtgggtctggatcgccgtgggtgcgatcgcgttgatcatcctggtcgtcaccgccgcgcggctgctgggccggctgcccgagctgcgccgggcggccgggcggttgcagcggcggcaggccgaggcgatgggcctgcaggccggggcggcccggctggagcagaccctgcagggcctgcagcagcgggccgagcgggcgcaggagcacgtggaacggatcaaggccggttccggccactgacctgaggcgttcgagccccgttgtccggcatgtcaaccgaatgcgcaagaatctcgcgggttccggcctacgacatcgccggaattgacacgtacgatggaccccgcaacctgatccgaccgactggagtctctccatgggcgccctcaagccatggcacctcatcttgctcgtcgtcgtcctcgtgctgctcttcggcgcgaagcggctgccggacgcggcgcgctccctcgggcgctcgctgcggatcatgaaggcggagaccaagggtctcatcgacgagaacaacaacgacaacctggcggagaaggccgacgcgcagtactcgcgccagccgctgcagggtgacgtgcagggcggctacccgcagcagggttaccagcagcagcccccgccgggctaccagcagccccagccgggttaccagcagccgcagccgggttaccagccgcacccgcagccgggcttccagcagccgcagcagccgccggcccagccgttcgtcgacccggtgcagcgcaccaacgaccgctgatccgcccgcgatggcttccctgaccctgcgtcgcaacaagaagccgagcaagttcgagcaggccgccgacggctcgatgacgctcatcgagcacgtccgcgagctgcgcaaccggctgttcatcgcctcgatcggcatcgttctcggcctgatcgtcggcttcgtcatctcgcagtgggccttcgacatcctgaaggcgccgtactgcgcgctgcccagctcgatcaacgaccggaccggcagctgtgagttcatcaccctcgcggtgaccgaccagctgatgcttcggctgaagatctcactctggctcggtctggtcctcggcgcacccgtctggctctaccagctgtgggccttcgtcgcccccggtctgcaccggcacgagcgcaggtgggcgtacctgttcgtcgcgctggccctgccgctgttcgccgccggcgtcatcatggcgtacctcgtgatcggtcacagcctggccttcatcatgaaggccggtgtgctcggccagccgaccaaactcgaagtcacgtcgtacgtcggcttcgtgatgaacatgctgatgctgttcggttgtgccttcgagttcccgctcctgctgctgatgctgaacttcaccggcgtggtcaccggcaagcgcctgctcagctggtggcgtgcggtcgtgttcctggcgttcgcgttcgccgcgatcgccacgcccgacccgggcccgttcggcatggccctgctcgccgcctgcatcagcgcgctgtacttcgtcgcggtcggcgtggcgatcctcaacgacaggcgcaagggccgcggcaaggagatctacgaaggcctctccgacgacgagatctccgctctcgacgaggagcgggtcccggtcggcgcctccgacccgatctccgccccgaccccggtcgacgctccgacacccgtggaggccccgcgttccatcgagcggcgcttcgacgacatgacgtgagctagctggctccgcttcgctccgcggcgaatcgcctggtaaccggtgagttgtcagccgttttctcgtcgccgcaaagagcgcggcggcgggaaaacggctgacaactcaccggcggcgattcgcgggaatggggggttggtctggcgaaagttggcggggtggctgctgtcctggcgggtctgtgggcggacgtcggcctagccaaggttggcggggagggtgctggcctggcgggtctgtgggcggacgtcggcctggccaaggttcgcagggcgggtgctggcctggcggggttcgcggggcagagggcggcctgccccaaggtttgtggggtgggtgccggcctgccccaaggtttgtggggtgggtgcggtgcgtcggggtgggggctagcctcggcggctgtgacgagcgacttcatcgcggtgctggcgaacgcccgggcggggcggggtcggcaccgcggtctgcttccgggggtgttgcaggcgctcggcggcgcggggcatgccgtgcgactgctggatgcggacagcggggccggcgcggaacgggcctgtcatcaggcggtggccgagggcgcggtggcgctggtcgcggtgggcggggacgggaccgtgcaccgggcgctccaggccgtggcgggtggtgggccgcgagtgggggagtcggcgccgcccggcgcgcagtcctggggatccgcgaatttcggggcggctgctgcgggggccgtggattccgggctggttgccgcgggggccgcggcgcggcgggtggggttcggagtggtcgcggcgggcaccgggaacgacttcgcgggtgccgtcggcgtaccgggcaatccgatcgaagccgcgcgggagatatccgcggccctggaagcgggccgtgcgcagtcgatcgatgcggtgctgacggcggatgccgtcgggcggcagcggtggttctgcgccgtgctggcggccgggttcgatgcgctggtgaacgagcgggccaaccggatggcctggccgcgcgggccccgacggtacgacctggcgatcgtgctggagctggcgcggctccgggcccgggcctacacgctggagctggacggcgagaccctgcatcgggacgcggagatcgtggcggtggggaacacggcgagctacgggggcgggatgcggatcgtgccggcggccgacccgtcggacgggctgctcgacgtgatctgggccggtggactcgggcggggtgggctcagccggctcacaccgcggctgcggcaggggacgcacgtcaccgatccgcgggtgcatcagcggcgggcccggcacgtgcgggtggccgccgaagggatcgtcggatacgccgacggggagcgactcggcccgctgccgctcgacatgaaactagtcccgggtgcgatccggttgctccggtgagccgggggtcagtttccccgggaagcacccgaacctgggggcatggcgatgaacacggtctccggcaccgcgaactcgatgacctccctggcgacgtcggtcttcggcaacgcccgccaggcgttcaaggcgatggccgaggcggccaccaaccagcagttcggcgcggacaccgcggcgaccgcgcaggccacccccggcaggtcggcgcggcgcggcaccatcctcgaccgctacatctgagccggcgcggggatcggctagctagctagcggcgcagggtcgggcacggcgggtcggcccgcggcgctgggttgggcacggcgggtcggcccgcggcgcagggttgggcacggcgggagggcgcacggcgcagggttggggcacggcgggtgggctcacggcgtagcgccgccatcggatcttcagatgcaaccggcgagggcgagcgtggcgccgaggccgttgttgcggcccggctcggcggccgggacgaccagggcggtgcagccggccttgaccgcgccggcgtccgccggggtgtctccgaccatcagcgtgcgttccggatcagcgcccaacatgccgcaggcgcgcaggaagatcgccgggtcgggtttgatccggcccacctcgaaactcagcgcgaacgcgtccaccagaccgtccagcccccagtgcgtgaacagcgggcggatgtcgaagccgatgttgctgaccacgccgaccttgatcccggcgtcgtgcagcttgcgcagggtgggctcggtgttcgaatatggcagccagccgtcggggctcagcaaccggtcgtagagcgcgtcggcaaggccctcgacatcggtcggcacggtggccgccagcccggtgtaggcggcccggtgactgtgcgcgtagagatcgcggtcggaccagtgctcggccagctgcggcggcacccggtgcggcagcgggccaccggcccggcccgcggtgaccagccggtcggccaggatcgtggccttaccgcggtccagcgtggcgccgcaggccgcggcggccgcgacgacccaggtcaccgggtcctcgacctgggcgagcgtgccgtggaagtcgaacaggacggcttccacgagccgcgcggacgggggatgttcgggggcaagcggcactcgtgcaccttaccgatgaccggccgatgcccccgagcgcccataccgtgtcgcacattgtcgtacccgcgaactagtcttttgttcatgactagtcccgccgacaggtatgcggaatccaagcggcgggcggcgcgggtcgccaccttcccggcgctcgacgacttcatgctcgacgtcggtttcgacctggacgacttccagcgcgagtcctgcgaggcgctggagcgcggcaacggggtgctggtgtgcgcgccgaccggcgccggcaagacggtggtgggcgagttcgcggtgcatctggcattgcgcgccggcgagcgcaagtgcttctacaccacgccgatcaaggcgctgtccaaccagaagttccacgacctggtggagcgctacgggcccgacaaggtcggcctgctcaccggcgacaacgtgatcaacgcggacgccccggtggtggtgatgaccaccgaggtgctgcgcaacatgctctactccggctccagccagctgaagaatctggcctacgtcgtgatggacgaggtgcactacctggccgaccgcttccgtggcgcggtctgggaggaggtgatcatccaccttccggcctcggtcaccctggtctcgctgtccgccacggtcagcaactacgaggagttcgccgactggctggtcaccgtccgcggcgagacctcggtggtggtctccgagcaccggccggttccgctctggcagcacatgctggtcggccggcggatgttcgacctgttccacgacgccgacgcggccaggaaacacgacgtccaccccgagctgctgcgctacacccgggagatggagcgccggctggagctcggcgagcgtgcctccgggtggaacgggcggggtggccggggccgccgctggcagccgccgccgcgcgccgaggtggtcgaccggctggagcgtgccggtctgctgccggccatcctgttcatcttcagccgggccggctgcgacgccgccgtccagcagtgcctgggcgccggtctgcggctcaccgacccggacgagcgtgccgagatccgccggatcgcccaggccaaggtcgccagcatccccgccgaggacctgtcggtgctcggctactgggagtggctcgacgggctggagcggggcgtcgccgcgcaccacgccggcatgctgcccgccttcaaggaggcggtcgaggagtgcttcgtcaacgggctggtcaaggcggtcttcgcgaccgagacgctggccctggggatcaacatgccggcccgctgcgtggtgctggagcggctggtcaagttcaacggggaagcgcacgtcgacctcactccgggggagtacacgcagctcaccggccgggctgggcgccgcggcatcgacgtcgaggggcacgccgtggtgctctggagtcccgaggtcgacccgcggcacgtggccggcctggcctccacccgcacctatccactgcgctcgtcgttccgcccgtcctacaacatggcggtcaacctggtcggcacggtcggcgcggacaagtcccgcgagctgctggagtcgtcgttcgcccagttccaggcggaccggtcggtggtcgggctggctcgccaggtgcagcgcaacgtcgacacgatgcagacctacggcgccgacgccgcctgtcaccacggcgacttcgacgagtatttcgggctccgggtcgccatcgccgaccgggagaaggcgatggcccggcagggggtggcgcagcgccggtcggcggccaacgactcgctgtccaaggtgcggatcggcgacgtgatccgggtgccgcagggtcggcacgccggcctggccgtggtgctggaaccggccgccggcgggttcggcgagccccggccgatggtgctcacccaggaccgctgggccggccgggtcagtcccgccgagttcggcggcgaggtggaggtgctcgcccggctgcgggtgccgaagaacttcaaccaccgctcccccggcgcccggcgggacctggccgcccaggtcagcggcaccgggctcgaccggcatccggaccggcggcgcagccggggccgggccaacccgggggaggacgccgagatcgccctgctcaaggtgaagctgcggcagcacccgtgtcacgcctgcccggagcgggaggaccatgcccgctgggccgagcgccggcaccggctgcagcgcgacaccgacgccctgcgggacaaggtggccggccgtaccgggtcgctggcccgcacgttcgaccaggtctgctcggtgctgacggcccgcggctacctgtcgcacgacggtgaggtcaccgaggccggccggacgctgggccggatctggtcggaggccgacctgctggtcgccgagtgcctgcggcaggacgtgtgggccggtctggcccccgaggaactggccgccgcggtgtcgatggtgctctacgagtcgcgccgcgagggtgaggaccgcgcctcggtgccgaagggaccgatcagcgaggcggtcgacgcctgcgccaagctgtggacggagatcgccaccgaggagggcgagcacgggctgtcgctgacccgcgagcccgacccgggcttcgtctggccgatgttccgctgggcgcgcggtgagccgctcgccaaggtgctggccagcggccacaactatgacgccgacatgccggccggcgacttcgtccgctgggcgcggcaggtgctcgacctgctggggcagattcgcgaggcggcggtggcgtcgccgggggtcaaggagaccgcgcgcaaggcgatcagcgcggtgaatcgcggggtgctggcctatcaggccggcctctgacacctgaagcgccggcgggccgggcgtcccacgcccggcccgcgacgtacggcccggtttcagggttaccggatcgggccaatgactcacggtgagtgacttgccggtgccctcccgccgcgatcatcgacgcatggtgaatctgcgttgacggtgtctttggggcgattcaagaattgcgggcgacagtgatggatgtcgctgagttcccttgtggggtgaaccggaagaaccgggagaaaggtacatggttgcgggctcgccccatctgatcgggtggtccggggacgcgcgcgccgacgccgtgctggcggtcatcgacccggagaccgcggtcatcgaggtgaccctgtgcgggccctgggaccggcaactgtccgcgcaggcccgcgctgtgctggacaagtgcctggccgagcacccgaccggcatgatcgtcgacctgcaccggctgaccgacccgcgtgcggtcagtgccgccctctggctcacgctctgcgcacagggcgcggcgatgcggccaccgatcgcgatcggggtctgcctgccggcgtccgccccactggcccgtcggctgcgccggctcggcgcccgcgactggctggtcatgcacgcgtcggtgcagcaggcgcacaccgccctggcccaccgccgcccgctgatcgaccggatgcagctggccctgccgcccgacccggccgccgcctccctggcccgggccctgatcggggacgcctgccagggctgggatctgccgcacctgctggagcgtggccggctggtcgcctccgagctggtggtgaacgcggccgagcacgccggcaccgacatcgcgatgatcgtgtcgtcgcgcggggagggcgtcaccgccgcgctgcacctcgcggtgcacgacggcgatccggcgctgccgcaggtccgcgacccggttccgggcccgctcgggccgtcgctcaccgaccgcggcctgggtctgcggatcgtcggggcggccgcctcggcgtggggcgcgcttccggcccggggtgggaaactggtgtgggcgatcctgcgcaaccgcccggaggtgccgggatgatcggcggacgcgacgagccgcggttcgcgggcgccggcgtggccggcgcccgcaccggtgaccggctgctcatccacctgcgcggcagcctggacgcgatgtcggtgaccgcgctgcagacccagctgtacgacctgacccgggtgcacgacgtgctgggcctggccgcaccggtccggcagatccacatcgatctggccgaggtggacttctgcgacgcggccgggctgcggatgctggtcgcggcccgctgtgtggccgatgcccgggacgccacctgtcacctgcgcaacccgcagccgcatctgcgctggctgctgcgcgccacccgggccagcgacctgttccaggtggactgagtcgcacacccgacgcgccgggggtgactgccgaggcgggctcctaccgtgtggggatggtggcttcgcaggagcatgtcaccgccgatctggcgcgcggggcgacgctcgtcggcggcggggtggcggtccggttctgggcgccggcggcgcggcgggtcttcgtggcgttcgacggggtgctcagctatctgcccgatccggcggacgagctggtccaggatccggtgaccggcgactggaccggctggtttcccggggtgggcgccggcacgaagtaccggttctacgtgatcggggccggcggggagggcttcaagcgggacccgcaggcgcgggagctggagctgtacggctatccggagtgtgacgcgctggtcgtcgacgacgacgcgtatccctggcacgaccaggggtggacgccgccgggcgcggcggagctgatcgtctaccagttccatgtgggggtgttcgcggcggccgatccgctgggccacgaccgcaggccgcaccgtaccgccaaactgctcgacgccgtgcagagggtgccctatctcgcggcgctcggggtgaccgcggtgcagccgctgccggtggtcgagttccagggggagtggagcctcggatacaacggcacggatctgttctcgccggagatggactactgcgtggatccgcacgcgctgccgccctatctggacgcggtcaacgagctgctggccgcgaccggggccgggccgctcaagttcgagcagctggccgggcaggtgaaccagttgaaggcgttcgtcgacgtctgtcaccggttcgggatcgcggtgctcttcgacgtggtctacaaccatgccggcggcggtctcgacccgcagagcctggactacatcgacatgccggccgcgccggggccggacaacaacgcgtatttcaccggcgacggctgggccggtggccgggtgttcgccttcggccggccggcggtgcgcgagttcctgaccgcgaacgcgctgatgttcctgcgcgactatcacgccgacgggttgcgcttcgacgaggtgaccgtgatcgacgcgaacggcggctggggtttctgccaggagctgaccggcacgctgcgggcggcgaagccggcggccgtgcagatcgccgagtactggggcgagttccgcgggctggccgtcgcgccgccgcccggcgggatgggtttcgacctggcctacgcggacacgttgcgcgacgcggtgcgcgcggtgctggccgatcggggagccggggtcggtcggctggtcgccgggttgcactcgcccggctggtcctacaactgcctggaaaaccacgacctggtcctcgacatggacgaccaccgggcgccgcggatcgccacgctggccgacagcgccgacccccggtcctggtacgcgcgcagccggtcccgggtggccaccggcctgctgttgaccgcgcccggtgtgccgatgctgttcatgggccaggaattcctggaggacacgctctggtcggacagcccggggcgcaccgaccggctgatctggtgggacggggcgctcggcgccgaccggcacatggtcgacttcctgcgctgcacgcgggacctggtccacctgcgccgggagttgccggcgctgcgctcggcggcggtcgacgtgctgcacgtcgacgaggacaaccgggtggtcgcgatgcggcgcggcgacgacgtggtggtgctgctgaccttcagcgagtccacgctgtacgactaccggctgaacctgccgtgggcgggccggtggcgcgaggtgttcaacagtgactactacgacttcttccccaacccgatggtggccgggaacgcgggcgcggtgaccgccgccccggaggtgtcactgaccgtcccggcgaacgggatgatgattctgcaggcggaccactgacagcccggccgggccgatcgcggccaccgcgagcgcggccagcaggccgtatccgccgatggtgagcagtccggtggaggcgagcccgccggccgcggcggcgacccagaccattccgtcgacggtgccctcggcgcgggcccgcagcggctccggcacccgggtggccaggacggcgctgcccccgatcaggcacaggttccagccgtagccgagcaggaggaacgcgagcacccggggcgcgccgaccgccgccaggaccggtccggcggcgaccgtgaccaggccggccgccatcaccgggcgggcgcccagccggtcggcgagccggccggtgaccggggacagcgcgaacatgccgagggtgtgcgcggacagcaccaccccgatcgtggccagcccgtggtggtgcacgtgcatctccaccggggcggcggtcatcaccgcgaccatcaccacctgcgcggtgcccatcaccagcagcggggtgcggatgccggacaggtccatccggccggtcggcggctccgcggcgaccgtgcggggcagggtgctagctagctaggaccacggtggccgggtgcaggacgccgagcagcagcgggccaccgaccgcgccgatcgcaccggcccagaccagcaggcccatcgcggtgccgcggtgccgcgccggatgcgtctcggccacggcgtagcgggccagcagcgcgccggcgttgccgtaacccagcagcaccagtgcgacgctcagcgggaccggcccacgggccgcggcggcgagcagcccgccggccaccgcgcagcagaaggcgaccagcagcccgtgccgccagccgcgccggctgaccgaccgggccaggatcagcgcgcccaccccggtgccggtgatcgcggcggtgctgggcacgccgccccaggccggcccgagccggtcggcgacgaccagggtggcgaccgggctggccgtcgccatcgcggtgttcatcgcggcggcggccacgaacagggacttcgccatccccccaagctatgacgagcgtctattcaggaccagacccgggagtcgccggcgaacagctccggggagctctgcaccggcaccacgcagaccaggtgcccgccgggcgcccggaggatccggtggccgccgcggtcctcgaccagctgggcgccgaagccgagcagccgggcggtctccgcctcgacgtcgtcggtctcgatgtccaggtggatccgcggccggtcgtcgaccgcctggacgaccacggcgacacccgggaccacgtcggcgacccgggtgtactccggctcgtccggatcctgccgggccgagccgcccagcgcggcggtccagaacgagaccgcggcgccggcctcggtggccggggtgtcgacgagcattccgaacaaccggcttcgatgcatgggccgaccctacgcgtacaggccgtccagcaccggccggaaacggtcctcgatgacccgtcggcgcagtttcagcgaggcggtcagctcaccggactcgacgctcagatgccggtcgagaacggcgaaccgcttcaccgtctcccacggattgagcgtgccgttgagccggtccacgcattcctgcagggcggcgcgcagcttttcggaaccggcgatctcggcgtgcgaggcgtccccgagtccgttggccgccgcccatttcgccatctcgtccggatcgaggtcgatcagcgcggtgacgtatctgcggttctccccgtgcaccaggaactggcccgccagcgggcagatcgccttgaatcgcgactccagggtctgcggcgccacgtacttgccgttcgacgtcttgatcaggtctttcttccggtcggtgatccgcagcgagccgcgctcggtgatctccccgatgtcgccggtgtgcagccagccgtcccgcagcgccgcgccggaatcgaggccgtggtagccctgcatcatgccgggtccgcgcagcagcacctcgccgtcctcggcgatgcgcacctcggtgccgggcagcggcattcccacggtgccgtattccgggcggtccggccggttgaagacggtggtggcgcacgattcggtgaggccgtaaccctcggcgatcggcagcccgatcgcgccaaaccagcgggcgatgcccggatcgagagtggccgctccggagatgaaataccgcatgcgcccgccgaaccgcgcccgcacccgggacagcacgagccggtcggcgatccggaatcgccatccggaacgccgccgtccggccgttgccacggcccagtccaacagccgcttctgtacgccgtcggcggcgctcaccgcggcatagaccttctcgaagatgcgcggcacggccggcatgatcgtgggccgcacctcaccgagccgctgcacgacccggctcacgtccccgtccaccgcgaacgggaagccgaccgagagctgacagctgagcagtgccttgccgaacgcgtgcgacagcggcagccacaggtagccgacgtcgtcgggccgcacgatgcccatcgcctggatcgccagcccctggtagacccacgcccggtgggcaacccggacgcccttgggcagcccggtcgtgccggaggtgtagatcagcgtggccaggtcgtccgggcggaccgcggcgaccgcctcggccacccgggccgggtcgccgagggcgcgcagctcggccagggtcagcacgcgcgggtccgcggcggtgccgtcgatgaggacggcgcgttccaccggcgtaccgggaaagaggatcttggcgagctgggccgggttctccgcgatcgcgaagcggctgccggagtcggtgaggatgtgtgccacctcgtccggcgacgacgaggggtagatggtggtggtcgcgcccccggcgcacatcaccccgaagtcggcctcgatccactcgacccgggtgccgctcgcgatcgccacccggtcctccgggtgcaggccgagcgcgagcaggccggcggcgatctcggtgaccgcccgcgcggtctgcgtccaggtctggctctgccagccgtcgtcgccgggccgcaggtaggccaccgcctgcggctggcgctcggcgacggccaggaacatcgcgccgaacgaggccggctcgtcgcgccgcagccgggtcaggaggtcgtgctcggccggtggggcggtgcaggtctgcgtcacgtctactccttgagcatgcgggtcagccagggggtgagctccggggcgagggccgtcaggtcaggggtgccgccggcgtcgagggcgtccgaggtgatctggcgcagcgcgtagatcgcgccgatgtgggcgttcagcgggacgccgggcgcatcgcgcaggccggcgatcagcgcggcgagccgctcgatcgcggcccggcgccgccggcgcgcgggccggcccagcgcgtccatctcgacctggaaggcgcgggcggcgacccggtcgctgtccagcacctgaaggtacgtcgtgacgaaaccgtctatcgacaccgctccggccgccaggcggctcatcagcacctcgatgaagcggtcgtacgcggtgtggatgcacgcgtccttgtcggcgaagttgtcgtagaaggcggcccgggacaccgccgcccgggcgcagatctcgcgcaccccgaaaccgcggtagcccgccccggccagcagctcggtggcggcgatcagcatcttctcccgctgggcggcgaccacctggtcccgggcgagctcgtgccggccgcggggcagcgacggcggggtggtgaagaccacgccgctggcgatccggtccggcacgggcggacatcccatctgagtacgtcttgttactccaatcttcccacgccgttcccgcgtcacccgacaagacctcccccgggttcggcaggatggaggcgtggagaccgacctggaactggcccagcgggccgcactgaccggcgcggccgaggcgctgcgccacttcgcggtgatcgccgacctgccgcgggagacgaagaaggacggcagcgtggtcaccctcgccgaccgggcggtggagaacgcgatccggggcgtgctgaccgaggcccggccgcaggacgccatcctcggcgaggagcacggcgagaccgcgagcggcaacggccggcgctggatcatcgacccgatcgacggcaccgcgctgttcgtccgcggtgacgaccggtggctggtgctgatcgccctcgaggtggacggcgaggtgaccaccggcgtgcagatcgtgccggcgcaggggctggcctggtgggcgcagcgcggtgccggcgcgtaccggggccgggtcgccggcggcgccctggtggacgcggagcggatccacgtcgcggcggcccacggtcgggcgaccgggagccggctcggtgtggtgccgctggactgggggcgggaggtggccgcgccactggtcgcggtggccgacgagcggacgtggccgatccacccgccgctgctggtggcgcagggcgacctcgacgtggcggtgcagaccggcgggcagatctgggacttcgcggccagctcggtgatcatcccggaggccggcggggtgttccgcggcctcgacggttcgccgcgcccgggcgccggcccgcacgtcttcgccagcaacccggcgctgctcgacgaggcgctgcggatcctccactgaaagacgccgaggacacgcatcggtcaggaatcgagaagcagcggaggggggccgattcgtagcgtggtgcccatgacaacgatcgactccatcagcgtcggagcgtccgaccccaccgccgccgcggcgttctaccgggccgcgttcgacctgggcgacatcgtccaggtgcaccgttcggacgcaccgaccaccggcttccgtgggttcgcggtctccctggtcgtcgcccagcccgccgacgtcgacctgttcgccgcggccgctctgcatgccggcgccaccgcactcaagccggtgaccaagggcttctggggctacggcggcgtcgtgcaggcaccggacggggcgatctggaagctggcgacctcgtcgaagaagaacaccgcgccggccacccggcagatcgaggccatggtgctgctcctcggcgtcgagaacgtcaaggcgaccaagcagttctacctcgagcacggcatgactgtcgcgaagagcttcggcagcaagtacgtcgagttcaccgccggaagttcgccgatcaagctggcgttgtacacccgtcgtgccgcggccaaggacgtcggggtgcccgcggaaggcaccggatcacaccggatcgccatcaacggtgacaccggcgggttcaccgatcctgacggtttcgtgtggaatgtctgacggccggtggcgctcccgggacggggagcgccaccgtcgcgggatcaggccgcgtagctgttcaggaaggcgagcaggtcctggttcagccgggtgtcggtgatgccgtgcgggccaccggcgtacacctgggcctcgctgccggcgttgtccagcaccagcaggcagcagcgcgcagagctggcgggagcgttcgtcgtcggtctcgccgatccgccgggacccgatctcacctgcgcgcagcagccgcagcagcgcgtcgcccggggtcatcggctcggcgtcggtgccccgcaggtcgaggtagaagcggccgtccgggtactgctcgcgcagctgctcggcgaggcggacggcgagggcggtcttgccgtaactcacgcagcctgcttccgaactccgacaccgcatcaagatcacatacggtgccggggtccggcagcggcgggcatcactccggggcgtgcagggtgaaggtcgtccacactccgacgtggacctgatccccgtccttcagggtcctggactggcccgcggtcagcggctggtcctcgtcgttgaggtacgtgccgttggtcgaaccgaggtcggtgaccagccacacaccgtcgatgttcagggtgagtagcgcgtggttgtgcgacacccccggatcggtgtcggccaggtcgatctccgggctggtgcccttcgacgagctggcccggccgatccggacctgcggcggagtcagcgtgatggtgcgctccccggtgtcggccgggaagctcaccccctccaccgcgttcatcgcgaagtacgccgggtcggcgaccaccgtggcggtccagtcggcggccggggccgccgggatcggcagcacctcggtcagctggggcaccttgcccgtggtgtggtcgtaaccgcagtcctcgcagaaccgggcgctgcccgcgcgtggcgtcccgcaatggggacagagttcgcccctgggtgcggtgtccaccagcgtcggcgggtcggccggcgcggaaccgatcagcgccccgcatgtgtcgcaatagtcggactcgccggagtcatgcccgttggggcagcggtaagtggtcactgcgaccgccctacccgcaccgtcttggtgctctgcgtgtccagcgccatctcgtccgccgcgttcaccttgcgccgcagccgcaccgtgccggtcgccgcgtcctcgatctccaccaccttggccagcagctcctcggtcgccgagttcccgctggcgtgcgccagctgtgcggcccggccgaacttcagcgtcgcggtccggtcgtcgccggcctcccgggcggcgatcccctcctggatcgcgtcggccagctcggcttgcccggtgtagtgcgccacctgccggttgatccgggtgctcagcgcggtgtcctcggtccacaccgcccgcaccagcgactgcgcgtgcaccgtgtcgccttcgaccaccgagatgcgcgcggccagcatctcgtcgcccgactttcccggtggcacgtcgatgcagacgtggtagtcgcggctctcctggccccaggagcccagcgggtagcgcccggcgcgcggaccgtcctcggaccgtttgccggtgaggtccagcacctgcggctcgacctgtttgacgaagcggaccgtggcgttcaccggggtccacaccttgagctgcacgtcggccgcggtcttgcccatggccgcggtgatcatctgctcgaacgccgcggtcagtccctccgggcgggccacgatgtcgacggtgcccagcatcgcggtggcgatcttgcgcagctcggagaccttccagttcgtgccgacgccgcggcagtcgcagacgaaccggccgccgacctgctccagcacgctctccaggtagccgtaccgctcgccgttgtcgccgtcggtgagcaggatggcgtgcttgatgtcgcccggtcgctggtcgaacagctgggcggccagcagcagccaggcgcccatcgcggtgccgccgctggcctgcagccggtcgatcgcccgcagcgcgtcggcgcggctctgcggggtggccacggccagttggcccgggtccgggaacagctgctgcgcggtgctgaccccggcgatgatggcgaaccggacgccgtcgtccaggcagttcaccgccgccttggcggcctgccgggcggccgccatccggccctcggcctgcatcgacccggacgcgtccacgatgatgatctcggtcgcctcggcgctgcggcggccgccgtcgccgcccgaggaggtgacggtgacgatcgcgttgacctcgctggcgcccatcgcgaggtactcgttctggaaagcctcggcgctgtaggacacggaaactccttatgcttcgctgggctcggtgatgtcggcgtcgccttcggcgtccgccgtggatcgcgggaccaccggcacgatggccacggtgatgttgtcggcgcctccggcggaattggcgtacgccacgagcgcccgagcggcctccagcagcgggcgtggcccggtcgccagggtcagcgccgaccgcaccgcgtcaccgaaatcggccgggtcggtcaggtagttccacagcccgtcgctgcagagcaccaggtggcccggcgtctgcgcggtgaacgcgccgagatgcggcaggatcggcccggcgtcggcgccgagccaggcggtgatcgcgtgcgccttcgggtcgttcatcgccacccgcgggtcggcacccatcgcgatcacgtgccgggcccacgagtcgtcctcggtgagctgctgggccgggccgccggcggtcacccagtaggcacggctgtcaccgacccacccgaagccgacgtgcgggccgcggaccgcggcggcgacgatcgtgcaggccgggttggaggcggcgcggcgcggatcgccgttgccgaccagggcggcgacggcctgcccggcctcctggatcgccgttgcgacgatctcggcgatcgccatcccggggtccggttcgccgcctgcttccggatcgattgccgcccgcggtacgtcgtcgtccgccggcccggcggccgcgacgctctcgaccggcccggtcgctccggccgcgtccgcggcctcggccacctgggcgggctccagcgggtgctgtgcccgggccagcaggtcgccggcggcccgggcggcggcctccgaggcgacgtccgggtcgaacgaggaggagacgccgtcgcagacgaccacgtcggccgcctcgacaccgaccgccagccacatggcgtcctcgttgcggtggtgccgccggccccggtcactgaccgcggccgccaccgtgtcgccgtccgcctcgacgtggtcgcgggggcgcccggccagcaggccgcactcctcgcagtagccgtcggcgtcgaccgcgccggccgccgcgcagtgcgggcagtcccggccgcgtcgaggcccggcggccgggctcaccggcgtaccgccgccatcgtccttgtcgttcggcggttccgcgccgtcgccgacggcggcggtctcggtcagcgggcgcccgcacgcctcgcagaacgcagcgccggacgcgcgcccctcagcacaggagtcgcactcggtcagaatcaacttgccttctctcgggacgtgccggtgtggtgcctactcaggtgcgggttcgcggccgggccgcgttcgccagatcgaccaggcggatcttctcggcgccgtgcgcggcgcgggccatctcgcggtacgcgtcctccagggcgaaccgcacctccttctccaccgtgtcgccggtgcgcgccgggccgagcaccgacgccggcacctggtggccgcccctgagcgaggacagcgtctgctccagcagctcggcgcgcaactcggcgagctgggcgcgctccacctcgagccgctcgatcagcgccgccgcgtcggtcagcgactgcacgtccacctgcgccaccggatgcgcccggaccagcgcccggaccgcgcccacctgggagatcgcgtacgccgaggaggtgcccggcacccgctggtacgcctccaccgcgccggcccggtcgccgccggcgagccggcagcgggccagcccggcggccgccgtcgtgtacgccggatcggtgcggctgaccacgtcgtaataccacgccgccgagccgggccggccggccagctcctcggcgaaggcgaaccccagctgcggggcgagctcgccgggcagcgccgcccagaccgcctcgaaccgggtccgggccgtggtccagtcctcgacggccagcgcgagcagcccgtcgtaccaggccagccgccagtcgtcgccgtgcagctcggcgaacgagtcccgggccttcatcgcgtcgccgaagaagccgtggcgggtgcccaggtcgatctccgcccgcagtgcccgcagccgcacctcgggggtctcctgcggggcgtgctggagcagggcgagcacctcggccggatcggtcaccgtgatcgaggcgaggaagaccgcggccgggtcggccaggtcgatcagcggggtgggcaggtcctgccagcgcggcgcgtccgacttcaggtcggtgcgcagctcaccggtgaagaccttggacggcgccggtttcggggtgccttgcgcggccaccacctggcgcagtacgccgagcatctgctcctgcatctcggccgcgtccacgaaccgctcgtccgggtcgcgccgggtggcccggtcgaccaggcggtagaacgactcgtgctgcttgtagacgtcgaacgagtcccggtccggcaggctctccttgaacgtcgtctggtagccgcggaagtccgtggtgagcacggccagggtgcggccgatcgtgtacaggtcggaggcgaccgacgggccgtcggtggccatctccggcgcctggtagccgaccgtgccgtagagcgccgcgtcctggtcgtcgatgtgcaccacaccgccgaggtcgatcagcttcatctggtcgccggactggatcacgttgtccggcttgaagtcgcagaagatcaggccgcgctcgtgcaggtagctgaacgccggcatgatctcgatgaggaattccagggcctggtccagcggcagcgggtcggcgtcgccgtggttggcgtcgcggcgctgcttgagcatgtccttgagggacttgccgccgacgtactccatcacgatgtagccggcgccgtcgtgctcgacgaagttgtagatcttgacgatgttcgggtgctcgacctcggccaggaaccgctgctcggccagggcggcggccagcgcgtcctcgtcaccggagttgagcaggcccttgagcaccacccagcggcgcgacacgttcaggtcgacggccaggtagacccagcccaggccgccgtgcgcgagggcgccggccacctcgtactggccgccgacgacgtcgcccttgaccagcttcggggtgaagttgaacgcctcgccgcaggacgggcagaagccggaggtgcggcccgggcggtcgccgcgggaccggccgaccgggttgttgcacttggcgcagtaccgcttcgactccgggacctgcgcgtccgccatgatcgtgctggccgggtcgaccctggcgatcggggcgatctcgaccaggccgctgccgaagcggcggctggagccggtgcggccgctgccgcggcggctggagccggtgcgggtggagagggcgccggtggtccgtgacgagctctgcgtcccggtgttccgcgaggccttctccggggtgcgctgtgccggcacgctcggcgcaccggcgaccggggccagccgcaggttgtcgcagtagccgtcctcgatggtgccgccgcacccgtcccgctgacatttcatgaccgggcatccctcgcgatcgtggcggtgagcatttcctggtacgcgtcgaccgcgcgccgagcctgctccagctcgcagggcgcggtgtgcagaagggtccgggcccgctcggcgagcggggtgagccgggggtgttcgccgagaccgtggcgcagcgccttggcctggtaggcgctgagccggccgcgcagctcgtcccggtcggcgagcaaccggtcgttgtggtgacgcaccgcggcgagcgcggccagccgctccccggcctcccgcgaccagcgggccagccgggggctgatcagcgcccactggccggcggccgcgagcgcctcgaccgcggccaggtcgggtcgcaggttcacggcgcggaccgtggcgatccggtcggccgcgaaccggccgtcgacccgctcccgggcccggatcgcctcccgctccgcgcggtccaactcgtcggcccggtcgcgggcgtcggccagccggcggtgcagcgagtcgcgcagctcggccgccgaggtgcgctccgcgtcggcccgctgcagcaggtcacggacccgctgcaggatcgccgggtcggcgccgagcgggtcgccggccagcgtgccggtcctagctagctagggcccgctgcagcgcgtcggccacctcgccggccgccggcagcagccgctgccaggcctccgaggcccgggtggcgacgtcgacggcggtgctgaacgagcgctccatcgcggccagcaactcggccggtgagcaggtggtggtgacctgcccggcgccgagcagcccgcgctgggccagcggcaccgtggtggtggagagaaggatcgacgggccgagcacgacgtgcacgtaggtggcccggtcactgtcgctgagccgccgctgggcgcgcagcgactgggcacgcgcgatcgactcggagagcatccggaaaccgtcccagagcgcggccatcgcgacgctcgcgtcggcccactcggccgccgtccggccggtcagcgtcgcggcgtccagctcctggcgggccggcagctggtcgagctcgacgaggttgcgcgacatggcttcgaccgcggtctcgaggcgcgccagctcggcgtcggcgggggctaccgatggtgccgtcatcggtactgtgccgccggcggcttcggcgccgcgccgaagcggcccagccatgtctcgtacgttttcgcccaggtgccgtcctgccgggcccggtcgagcaccgcgttgacgaaccgggtgaactccgggtgctgcttgttcatcgccatcccgtacggctcctcggtgtatcgctggccgaccaccttcgcatacgggtcctgggcggccatcccggccaggatggtgtcgtcggtggagatggcgtccacctcgttctgctggaaggcgaccaggcagtcgccgaaggtgggcttggcgaccgggatcggcttggtccgcaccctggcgatggtgtcgtacgacgtcgagccggtcgccgcgcacaccttctgcccggccaggtcctcgatcccggtcgccgtagagttgatcttgaccagcaccttctgcccggcctcgtagtacgtcgtggagaagtccacgtccttccaccgggcgcagttcgcggtcatcgtgtcggcgaccaggtccacgtcgccgcgcagcaccgcgttgacccgctcgttgtacgggatcaccttgatctgcaccttgtcccggtcgccgaagatcgcctgggcgaccagccgggccatgtcgacgtcgaacccctcgaccttgccggtctgcgggttgcgcgagctgaacagcagggtgtcctggctggtgccgaggatcagccggccgcgctgccggatctgggccatcagcgaggcggccggcatcgcgcccggctgcggcagggcgccgctcggccgcaggctggcccgcgggttgcaggaggtgtccggggccggcgtggcgccggtggacgggccgggcgcggcgtcgatcaccgtgccgccgctggtggtggggccgggggtggcgtcgtagcgcggcgacgagtcgccggcgcagccggctgagccgagcagcagcgccgcggtgacgatcagggcgagacgggcacgcatcaccggtattcctccagacgggcgcggatgcccacgaaaaccagcgcacaggcggccagggcgagcaggggaccgagcacggtcagcagggtcagcccggcgccggccccgtcgatctcgtcggcgaacgccgcccgccgctcgctgatcgaccggtccagggcgtcggtgagcccggtgaacgcccgggccgaggtgtcgctcagggccgccttgaccgcgccgtcgtagtcacccccggcgttcagcttctgcacctgcccgtgctcctgcacgtaggccgcatgctgccggcgggcggtgtccagcaaccccggcgaggtggcccctaggcggggatcgtcgaagttgacccggccggagaccgccgcgaagtcggcctccttgtcgaccgtgccgcgggacccgagggtgagcgcctcgtcggcccgctcggtgagcgccgcgatccggatctcggccagcgccgcgaccggggccgacccgtcccgggtggcgtcgtcgaggtgtgcccgctggttggtgaacagcacgccggtggtcagcgcgagcagcgcgaagagggcggtggcggcgaccatcgggacgttgaaggtgcgccgggtggtccggctcaggtagccctggccggcgaccagcgcgatgcccagcgccacgaacagcaccagcagcaggatcagccaccaggagctgcgggccgtcgcgtagccccgggacaggccccggtcggcgacccggaacagcgcctgcgcctgcggctgcagggtctcccggttgagctgggaggcggccgccaggtaggaggcgccgatcggcaggttctgccggttgttcgcccgcgcggtggcgaccagagcggcgtaccgggagatgccggtggccagcgcctcgacctgacggtcggcgtcgctgtcgtcgggcgccagccgggcggcccgggtcagcgcggcgccggcccggcccaggtcgtcgtcgtaccgctgggtcatcccggccggctccaggccgccggccaggaacgcctgggccgcggtggtgtccgcgtcggccagcgtcgagtagatcgtttcggcctccaccatcagcggctgggcgcgccggccgagatccgcggtgccggcgctcgccgagtgcgcggtcagcccggccaccaggccggtcagcaggcccagggtgagcaggccggcgaggatcagctgcagccgcccgggggagtggtgacgcaggtcggcgacccggcgcgccagccggcccgccggcggcgaataggccgcggtcgccgtgggtcgatgcgccagggtggtggtcacgcgtgcctcccgagtgcgggtcgttcctagccgtccactgtgcgtcaccggtgcaaccgatcatcgccagcgctctgtcacagccggtgcccggcgaggtctcccgccgggcaccggtgtcgcctgctgtcgccgcgcggctcagtcgagctcgcgtttgagcagtttgccggtcgccgtcatgggcagcgactcgacgatcttgacgatccgggggtacttgtacgaggccatctgctcccggctccaggcgaccagctcgtcctcggtggccgaggcgcccggcttgaggatcacgtacgccttcacctcctcgccgtggctggggtgcgccaccccgatcaccgcggccagcgacaccgcctcgtgggtgagcagcacctcctcgatctcccgcgggtacacgttgaagccaccgcggatgatcatgtccttggcccggtcgacgatgtagtagaagccgtccttgtcccggcgcgccagatccccggagcggaaccagccgtcccgcatcacctcggcggtcgcctccggtcggttgtagtaccccttcatgatgttgtggccgcggatcgcgatctcgccgatctcgtccacgccggtgaccgtgttccactcggcgtcgatcagcttgacctcgacgccccagatcgggatgccgatcgagccgggccggggctcgccgtccgggtcgctgaaggtggccaccggggaggtctcgctgagcccgtacccctccaggatggtgaccccgaagcgctcccggaccgccttgatgatctcgatcggcaggctggagccgccggagacggcgacccgcatgttcgccgcgatccgctcgacgtcgacgccctcgttggcgctgagcgcgttcagcagcccccagtacatggtgggcacgccggcgaagaaggtcacgttctcgtcctgcagcagccgtacggcggcgttcgcctcgaaccggggcagcagcaccagggtggccgccaccgagaagccggcgttcatgttgaccgtcgagccgaacgagtggaacagcggcagcaccagcaggtgcgtgtcggtggccggctgggagttgaacagccggttgcaggtgagcgcgttgagcaccaggttcgagtgggacagttcggcgcccttggcctggccggtggtgccgctggtgtacaggatgaccgcggcgtcggtctcggcgcgcagcaccgtctcgaaggtcgggccgtgcccggcgagggcctgccccagggtttcggtgccctcgatcggcgaggcggccgccgggtccgcggtgatcaggaagaagtgctcgcagtccgcggcgccctcgaagccggcccggccctcgacgcccatcggcagctcggcggtgccctcgaagcagaagtacgccgtcgcctgcgaatccttcaggtggtacgtgatctcccgccccttgagcagcacgttcagcggcaccacgaccgcgccagccttgaggatgccgtagtagacgatcgggaagtacggcaggttcgggcaggagagggcgaccctgtcacccggctggatgccacgcgcgaccagcatgttcgccacctggccggccgccgcctccacctgggcgtaggtcaggcgctgcgggccgagcaccacggcggcgcggtccgggtgacgacgggcgctgtcctccagcagaatggagaggttgagcatccggtggatcccttcgagtggtgctgtgactggtgctgtgacggcggtctcatcccaacatgagcctgcctcgcggcggaaccaccgtttcggcattgtttccccggcggtattcgtcaggtcgccggtttttgtgccgatggcgacggcgtgggaattccggtgatggaagcggtgcacgtcggtcggcagccgatcttcgacgcgcagggcgctgttgtcgcatacgagctgctcttccgcggccgtatggacgacgtcgcgtcgggccgtcaggacacctatgcgaccagcaccgtcatgatcaacgcgttcaccgagttcgggatcgcggaggtggccggcaaccggccgtgcttcatcaacctcacccgtgagttcgtgaccggccggctgccgttgccgttcggtccggaacaggtcgtgctggaggttctggagacggtcaccgtcgacgacgaggtgatcgaggggatcacgcagctgaccgcggccggctacaagatcgccctggacgacttcgtctggggctccggtcacgaacagctgctcgcgctcgcctcgtacgtcaagctcgatctcctggacggcgacctcagccggctcgacgagatcgtcgccgcctgtcgtcggtacccgggcatcgcgctggtcggcgaacgtctggagaccgacgagcagatcgcgatcgcggaccgctacggcatggaactgcggcaggggtacgccctgagccgcccccaggtgctcagcgcccccagcatgtccccgtcccggctgcgccgcctggaactggtcgcggccctgatgtccccggacgtcccgctggagaagatcacctcgatcatcgtcagcgatccggctctggccatgcgcgtcctgcgggtgagcaactcggtggcggccggcgtggtcagccggatctcctcggtgcgccaggcggtcatgctggtcggcctcacccggatccgccgctgggccaccctgatggtggtcgacgacgtcgccgaggccccggaggagcagctgctcaccgcgctgacccaggcccgcctctgcgagaacctggcccagcgcttcggcgccgacccgggtgccgccttcgtggccgggctggtcaccgggatggcccggctgatgggtttcaccccgaccgcgatggctgagcacctgcccctgaccagcgacgtctcggacgcgctcacccacggcaccggccgtctcggcatggtgctgggcgcggtccgggcctacgaggccggcgagcccggctccgaggacctggccgtcccggcgctggacgcgatgcgctggtccacccgcacgctcaccgccgcgcaccggttcaaccccaagcggcgtcgctgaccggggcccggctatcggctgacttcagtgtgctaccggtatttccggtaaaaggcacatccagcgctttcatccctgtaatgatcattttgggatgcaagtgggcgggggacggtgggacacatggggttcgaggagcgcgcgaccgcgccggtgatgagccggcgcaccatcatcacgctggatctccccggcggggtgccgtcgatctgccggctccggcccaccgacccggtcaccgctgaacgcttcgtggtccggcgcgaactcgccccggcccactgcggcgtgccgatgatgctgcgcgtccgggtgctcgacgcggtcgaccgtccgctgcccggggcggtcctggagatcatccaccggggcccgctgccgaccgcgcccgaactcagcggtgcccaggtcaccgacccgcacgggtacgccgagttcaagacggtctatccgggctgggcgtcggaccggccggccggcatcgacctggtgctgtacctggccggctcgtgcgaccggggccgcctgcacttcccggccccggtgaccgcccaggtcgcgaggctcacggcgtaccgggagaacccggacccgctgccgccgccggagccgccggccgggttcccgaacatcgtgccccgcgaccgctacgacctcgcggccggcctgctcgcctcgatcaacgcggtcaccgaccggtagctccgcccggcggctcggatcggcgggcggacgcggcctggtccgccgcggcggcggcccgcaggtgggccagcacgagcggatcgatcgacccgggcacgatgcgcatctccaggttctcgatgccggcccaggacgccagcgcctcgtccaggtccggttccgtccggccggccccgcgcagccggtccgccacctctgcggccaaggagccggtcagcggcagcagcgtcgtcgggtcggggcgttcgaaatacagggtgtgcacggcgagcagccgggcgagttcggtgaccgggtcggggtggtcgtccacccgcaggtcggccaggacgtcgccggtgcccgcgtacccccgtcccttggcgaccaccagcagcgccgcgctctgccgcccgcgccggtcaccgcccgcctgatcgcccgcgcggagcgcggtgaccagccgatgcgccagccgcgcctcgccggtggaccgcagccaggtgtcctccatgtcggccacgacggccggcccggccagcatgttgccctgaatggcgtagccgtcgccggccgtcccgccggcccacgggtggcaggccggcccggtgtaggtggcgcccggcccgctcgcgccgaccacgccgacctgccgatgcccgaccgggccgtcgtcgccggcgaccagcgcccgcaccgtgtgctcggccggcacgccggtggacagcagggtgagggcctgcgggcggtaggcgaggttggcgtacgactgggtggcgaccgctcccacgtcggcgagggcggccgggaccgccgcgccgacgccgaggaacctgctggcgacggccaccccgaacatgtcggcggagcgggccacgatcgagaacgtcatgtccggcacgctatccgatccgcagcgggttgtgatcttcgtcggccggcgataacgtacaaccaaatggttgtagatggagcgaacgaggaccgcgtgttccacgcgctctccgacgccacccgccgcgacatcctggcccgggtcacccgggccggggagtcggtctccggcctggccgggctctacccgatgagcttcgcggcggtgcagaaacacgtcgccgtcctggagcaggcgggcctggtcaccaaggagcggcggggccgcgagcagatcgtgcacggcgacgtggccgcgctgcgcggtgtcgtcggcgggctgctcgacacctatgaacggatctggcggcagcgggccgaccggatcgccgacatccttctggaggaggagcagtgaccgtccgcgagacgattcccgacgccgaggcgttgaccctgaccttcgtcaccgagttcgacgcgccggtcgagcgggtctggcgggtctggtccgacccgcgccggctggagcgctggtgggggccgccgacctggccggccaccttcgagcggctcgacttcgtgccgggcggtgcggcgcgataccacatgaccggcccggacgggacgaaggcgcgcggctggtggtcgatcaccgcgatcgacgagccgtaccggttggagtacgacgacggcttcgccggcgacgacggtgagccgctcgacgccgatcagccgatgcacgccgtggtgaccctggaacgggccggcgaccgcacccggatgaccgtggtcaaccggttcgccgacgccgcccagttcgagcggctgatgacgatgggcatggccgaggggatggggctggcactgggccagatcgacgagctgctccgggcggcctgacggcgtccccgacggccgctcaggtgccggccgcgtccatcaccgcgcgcaggtgccccatcgggtcggtcagctcgccgggcagaaagtcctcgtaccagatccggaaggcggcggtgctgcaggcgaccagcagccgccgccgccagtcggccggatccgccccggggtgccgcgcggcgagcatcccggcgatgtccggctcggtgtcggtgcggatcaccaggccgcacgtgcgcaggtgggtggagtcctgcacgacggtgcgcagcgcggcgagcagctcccggttggtcaccacgtgccgggccagccgggtcatcgcctcgcgcatcaccgcccggtcgtcggcctccggcggtgcgccggccacgtagtcggtgaccagcccggtcatctcccggacgggctccgcgaccacgtcctgcttgccggcgaagtaccggtggaaggtgcgcggggcgatgtccgccgcggcgcagatgtcgctcaccgtcacgtggtcgtagccgcgctcgatgaacagctcccaggcggcccgtacggtcgccacccggttctgctcccgtttgcggtctctcaggttggtgccggtcattccgggattatcgccgacgccgtgtcttggcgcggtctgccttgtggcatggtctgccacgagattgacgcagtcgggatgacccacgtgcccgctcggagcgggcggcgaccaccgacgcggccctgccggagtgaccacggcggtgatgcggccggcgatcaccgccggccgcgtcacccgcggtccgctgccggttgcggcggcgatggcggcggtacgcgggtggcagggcacaatcggggaatgcagccggcgcgggtggatcatggcgtggtcagcgggacgttcagcctggacgggcagacgttcgacgtcgacaacaacgtctgggtggtgggcgacgacaccgagtgcgtggtgatcgacgcgccgcacgacgtcgacgcgatcatggcgatcgtgggcgagcgccgggtcaccgcgatcgtctgcacccatgcccacgacgaccacgtgcgggtcgccccggcgctgcgcgagcggaccggcgcgccgatcctgctgcaccccgccgaggccccgctctggaagctgacccacggcgacgcggtgacctgggacgcggacctggccgacggtgaccgggtccaggtggccggcaccacgctgaccgtcctgcacaccccgggtcacgccccgggcgcggtctgcctgcacgcccccgacctgggttgcgtcttcaccggcgacaccctgttccagggcggcccgggtgccaccggccggtcctactccgacgccgacctgatcgtggcgtcgatcgaggcccggctgttcaccctgccgggcgcgacggtggtgcacaccggacacggcgccgacacgacgatcgcggcggagcgcgcctgagcggcggtgtcagagtctggcgtccagcgagaccagcccgggatgggtgcgcaggaacgcagcgatccggtcccgctggacggccgcgaagaacggcgtgaccgtcggcggcagttgctcaccctggtaggcgccgttctcgaagagcggatagccgggcaggccgatcccggtcatgtccctggtccgcagcgaccccagggccgccgcccagtcggcgatcgggtgcccgttgccgatgaaggtgagcgagctcccgaccgtcgcggtcagccgcggcagggcggccggatcggtgaggatccgccgcttcatcttcttggccagcgcctgcacgaactgccgctggtgacgctgccggtcatagtcggagtgcggcagtccgtaccgttgccggcagtagtcgagtgcctcccagccctggaagtgcaccggcttgtcgctcttcggataaaccttctgcacgccgatgtacggccggtggcagtcgtcgtggcccgggcactgcgggagccggtcccgcgaggtgccgtccggtttgcggtgctcggagacgaccgtctcgtccaccggcacgctgactccgcccatcgcggcgaccagcgtggtgaacccgccgaaattcaggatcgccccggcgtcgaaccggatcccggtgacgttccggatcgtctcggtgagcagctcgaagccctgcgccggactgtaccggtgctccccgatccggctgcccagcgccatcgccgcattcagcttggcccgttgcgccgggctgcccgacttggcgaacgccgggatcggcaccaccagatcccgcggcagggagaacaggtaggcgccgctgcggtccgccgggatgtgcgcgaccaccatcgagtcggagagcggcgcggtgtggtcgtcgcgcgggtcgatgccgatcagcaggatgttgagcggtccccggatcggttcggtgagcgccccgatcacccccgcccgcaactgcgccgcggcggccggcagcccgcccagtgccgtggccgagagtccgccgagcgtgttcaccggcccggcgaatccggcggaggtggccagaaggcacccgacggcgatgccgcacttcgcccagagccgcatttattctcctataacccgattcatcccaacctgcggatggtcgcacgggacgccggcctgctcttagcgaacgcttaggtttccgcccttcacgtcttaggcgcggcgccgaatcttgaggacatgaccgcgacagctctgcgccccccgaaagcgcccctcggcaacaccccgcgctggtacgccgacctcggtggcgtggccgccgcgatcagcctgctgatcgtggtggcgctctgggtgggcaaccgcgggctgcagcagatcgccgggggcggcgccgaggcgatgtcggcggccggccggctgaccggcctgatcgcctccgacctgctgctgctccaggtgctgctgatggcccggattccggtggtcgagcgcgcgttcgggcaggaccggctggcccgctggcaccggtggaccgggttcacctcgttctggctgatgatcgtgcacatcgtcacgatcacgctgggctacgcggcgtccgcgcacgccaccgccttcgccgagctgtgggacatgatctggacctacccggggatgctgctggccaccgccggcacgctgctgctgatcctggtggtggtcacctcggtccgggcggcccggcgccggttgcgctacgagtcgtggcacctgctgcacctctacgcctacctcggggtcgggctggcgctgccgcaccagctgtggaccggcgccgacttcaccgcctcggccgccgcccggctgtactggtggacgctgtacggcgtctcggccggtgccgtcctggcctaccggatcgggctgcccgcctggcgcaaccaccggcaccggctggtcgtcacccgggtggtccccgaggggccgggcctgacctccgtctacctgtccggccgggacctgtccgggctgccggcccgggccgggcagttcttcacctggcgcttcctggacggtccgggctggacccgcgccaacccgtactcgctgtccgcgacgccgggcggcgaccagctgcggatcaccgtgaagaacctgggcgacagcagctcccgggtggcgaacctgcggccgggcacgaaggtgctggtcgagggcccgtacgggaagctgaccggggagacctacaccggtggcccggtggtgctggtggcctgcggcatcggcgtcaccccgctgctctcgctgctcggcgagctgccgtaccggccgggcgaggccaccctgatctaccgggcccgctccgaggcggaactcgccttccggggtgagctggaatggttcgccgcgcaccgcggggtccgggtggtcaccctgctcgggccgcgcgccggccacccgtcctggctgcccgccgacgtcgccgcgcacggcgacgtccaggcgttgcggcagatcgcgccgcagatcgccggctcgcaggtatacgtctgcggccccgaggcctggaccgcacaggtgcacgccgcggcccgggcctccggggtcgccgccgaccgcctgcacaccgaactcttctcctggtaaggaagcccccatgcgtcgcatttccctgtggatgctctccacggtggtcggactcgtgctgctcttcagctaccggaccagcctcggtggcggcgccgtcgccaccgccgcgacggtcgccaccgccggtggcaccggcaccggcaccgcctacgacgggtccaccgcgtcgacccggtggggcgacgtccaggtccggatcaccgtcgacaacggcaggatcaccggggtcaccgtgccggtctacccgaccgggaacggcaaggaccaggagatcaacgcgtacgcgctgcccaaactggtccaggagacgctgaccgcgcagagcgctgccatcgacgcggtctccggcgcgaccgtgaccagcggcggctacatcgagtcgctgcaggccgcgctcgacgccgcccacctctgaccggcgaaccggaggctggcagggtggagagcatgcggatcctggtggtggaggacgacgcggcggtgcgcgactcgctcgcccgcacgctgcggttcgagggatatcaggtggagatcgccggcgacgggctgcaggccctcgacgcggtccgcgccgccgagccggacgcggtgatcctcgacgtcagcatgccccggatggacggcctcgaggcgtgccggcggatgcgcgccgacgggctgctgctgccggtgctgatgctcaccgcccgggacagcgtcggcgaccgggtcgccgggctcgacgccggtgccgacgactacctgatcaagccgttcgccctgcaggaactactggcccgggtccgggccctgctgcgccgctcggcgctgaccgcgccggccggcgccgccggtgcgacggaggcgggtgagctcctggtcttttccgatgtacgcctcgatcccggcacgcgggaggtgcagcgggccggtcgccagctgcggttgacccgcaccgagttcgacatcctggaggccttcctgcggcatccgcggcaggtgctgacccgggccgcgctgttcgagcaggtctggggctacgacttcggcgagcagtccaacagcctgcacgtctacctcggatatctgcgccgcaaactggaggcggagggcgagccccggctgctgcacacggtgcgcggcgtcggcttcgtgctgcgggaggagccgctgtgagacggtccggacgctggtggcgggcgcggacgctgcacacccggctggcgctgctggtcgcggcggcggtgggggcggccgtgctgttcgtcgccgccggcgcctgggtggcggtccgcgagatccagcggcatcaggcggacgggcagctggccgacgccgcccagcagatcgccgccaaccccgggcagtggctggccaccgaatcgtcccggacccgcgacctgcccactctgccgccgccgcacggcccgggccgcggcggtcaccacggccgcgagatcggcacgtgctggcagatcctcaccgcggccggcaccgcttccggcggcagccgcaccaccctgccggtcaccgccgccgccaggcaggtggccggcggcgcccgcacccggcccgccaaggagcagatcaccctcggcccggactcgtacgtgatgctcaccgtgccgctggccggcgggggagcggtccaggtcggcatggaccaggacccgggggagaacgtgctgaccgcgttcgccgccctgctcgccctgggctgtctggccggggtcggcggtgccgcgttgctcggccgcacggtggcccgggccggcctcgccccggtggaccggctcaccgaggcggtcgagcacgtcgccgccacccaggacctgagccggtcgatcgaggtggacggcaccgacgagatcgcccggctgggccgctcggtcaacgcgatgctggccgccatcgacgcctcccgcggcgcccagcgggccctggtcgaggatgccggccacgagctgcgcaccccgctgaccagcatccggaccaacgtggagctgctgctcgaactggaacgccgccccgagctggcgcaccggctgcccccggaggaacgcgccaagctgctcgccgacctggacgcccaggtgcaggagctggccacgctgaccaccgagctggtcgagctggcccgggaggaggcgacccgggagacggtcgagccggtcgacctgtccgaggtggtcgccgccgcggtcgcccgggtccggatccgcgcgcccgggctgacctacgacaccgacctcgcgccgtcgaccgtcgacggccggcccggcgaactggagcggatggtggtgaacgtgctggacaacgcggcgaagtggagcccggccggcgccgtggtccgggtccggctggccggggccgagccggggtggaccgaactgaccgtgaccgacagcggcccggggatcgccgaggaggacctgccgcacgtgttcgaccggttctaccgggcgacggcggcgcggtcgatgccgggttccggtctggggctggccatcgtggcgcagaccgcgtcccagcacggcggcacggtgatcgccgcccccgccgacggcggcgggaccgtggtgacgatcaggctgcccgcggcggcctaggcgggccgcgatgatccgctcgcacgacggcgcctcgaccaggcgctcgccgggcagatgtgcgccgcgcaggacggcctcgcgcagcgtgccgcgggcccgggcggtgctgggccaccgccgtgcgccccgagggattagggtccacttcggccggccgtgacgcaggggaagaggcagacagtggctgacgagatcatcgggatcgtgggcgcgggcatcgtcggcctggcgatcggacgggagatcacccgacggcggcccggcaccagggtcgtggtgctggagaaggagagcgcggtcgcccagcaccagaccggccacaactccggcgtggtgcacgccggcatctactacaccccgggcagtctcaaggcgcagctgtgcacccgcggccggtcgctgctcaaggagtactgccaggagcggcagatcccctacgacgaatgcggcaagctggtcgtcgcggtccgcgccgacgagctgggccggctggacgacctggagaagcgggcccgggagaacgacgtgcccggcctgcgccgggtcgatccggccgggatccgcgagatcgagccgcacgccgccgggctggccgccctgcactccccggaaaccgcgatcaccgacttccccgcggtggcccgggcgctggccgccgacatcgtcgcggccggcggcgaggtccggctgaactggccggtcaccggcctggacagaacggagaggatcgaggtccgctccggcgaccgccgcctgacggccgaccggctgatcatctgcgccggcatccagagcgaccgggtcgcccgcctcgccggcgaccgcgcggagccgatcatcatcccgttccgcggcgagtacatgcgggtcacctcggccaaggcggacatggtccgcggcatgatctacccggtccccgacccgcgctacccgttcctcggcgtgcacttcacccgccgcgtcaccggcgtcgtcgaggtcggcccgaacgcggtgctcgccaccgcccgggagggctaccggcggtccgcggtctcggttcccgacctggccgcgctcgccgcctggccgggcgcctggcggatggcccggcagcactggcggaccgggatcaaggaggtccgcggctccgtgtcgaagacccgctacatggccgaggccatgcgctacgtcccggagatcggcccggccgacgtggtccgcgccggcgccggcgtgcgcgcccaggccctggaccgggacggcagcctggtcgacgacttccggatccaccggatgggcgcggtcaccgccgtccgcaacgcgccctcacccgcggcgacgtcctgcatggcgatcgccgaacacgtcgtggacgcaatcttcgcctgacgcccggccggcgggccggtgctaccggtactcggcatcacaggtgatgctggcgatgtaatggttcaccggtgcctgcaccacctgcaccttctggacgcccggcaggtgacggaccgtggcgtaacccgtgcagtcgaacagccgacccttggtctccaggctgaacgactgcggcatgacatccgggttcacgctgtccaggaagtccgggtcgtccttgaacaactccttggcgtgtcgccacgccttgtctcggtcgatgaaggtgatcggcccgaccggctggaaggcgggaagtgccgcttcgatcgccgccttctgctcagcggtgacgtcatccttcaggtacacgctgacactgaagtgctgcaccggctgtcccggcagcccgcggaccagccacacgccggtcgccacggccgcccccagcaggatcgacaccacgatggcgcccgcgaccaggctttgccggatccacgttcgatccggggcttccggcgtctccggggttcccggcgtcgccggctccacggtcggttcagtggcttctgcggtcacgccggcgtcgtctgacacggccgatgagcctaacagcgaagatcatcattgccgcggacgcctggtggccggggccggaccgccgttcggcggcgggcggccgggacgaccagcggggtgccggtctccgggtcgtcgatgacccggcagggcaggtcgaagacctcctcgaccaggctcgcggtcagcacctgcgcgggcggcccggccttgaccacccggccggcgcgcatggcgatcaggtgggtggcgtagcgggccgcgtggttcaggtcgtgcagcaccgcgaccagtgtgcggccctggcgttcgtgcaggtcggcgcagaggtcgaggatctccagctggtgggcgacgtcgaggaaggtggtgggctcgtcgagcagcagcagcggggtctgttgggccagggccatcgcgatccagacccgctggcgctgaccgccggagagttcgtcgacgctgcgggtggccaggtcggcgacgccggtggcggccatcgactcggcgacgatccggtcgtcctcggcggaccagcggcgcagcaggccctggtgcggataccggccgcgggagacgagttcggcgacgctgatgccgtccggcgccgtggcggactgcggcaacaaccccaggacccttgcgacggtacgtgtcggcagggactgcacgtcggccccgtccagcagcaccgtgccggtggtgggcttgagcagccgggacagcgcccgcagcagggtggacttgccacacgcgttgggcccgatgacgacggtgaacgagccgtccgggatcgccacgctcaactgttcggcgatgacccgcttgtcgtatgccagggtcatcccggtgccacggagccggctcatcctcgtacccccagggattctctcatcagatccggcccgcccggcgggcggcgatcagcagccagatcaggtatccgccgcccagcgcgccggtgaccacgccgaccggcagcgcatggccggagtgcatggccagccagtccgcgccgacggtgagcagcgcgccgaccgccatcgacggcagcaggccggggccgggcgcgcgggtcagccggcgggcgatgttcggcgcgatcagcgcgacgaagttgaccgggccggccgccgcggtggcgcacgccacgatgatcgaggcggtcagcagggcgccgttgcgcaatcgtctgaccggcacgccgagaccggccgccaggtcgtcgcccatctccagcatccgcagaccggggccaccggccagagccaggatcgggacggcgaccagcagtacgccgagcagcggcagcgcctgcgtccagccgcggccgtcgaagctgccggtgagccagagcatggcgcgggcgttctccatctgctggcccctggtgagcagccagccgatgacgccgttgaggatcgcggtcatcccgatgccgatcaggatcagccggtagccccgcaggccgcgccggccgccgatcagctggatcagcagggcggtggcgaccccgccggcgaccgcggcgagcgcgagcgcggtgctgccgccgccgaggatcaccacggtcagcgccgcggcgcccgcgccgctggtgatgccgaggatgtccgggctgcccagtgggttgcgggtgatcgactggaagatcgcgccgccggccgcgagggacatgccgaccaggatcgcggtgatcacccgggggagtcgtagctccccgatgatgaacgcctgggcggcgctgccctggccggccagggtcttgacgacgtcggccggggcgatcgggtagtcgccggtgccgagcgtgagcacggcgaccgcggtcatgagcacgatggcgacgagcgggaccaggcgggttctcatcgggcgacccgcaccaggtagaggaacagggggccgccgaggaccgcggtgaccacgccgacctgcaattcgccggggctgccgacgacccggccgagcacgtccgcgccgaccagcaggaccggggcgagcaccgccgcgtaggggagcatccagcgcagatccggcccggtgagcgggcggaccaggtgcgggacgagcaggccgacgaagacgatcgggccgcacgccgcggtggccgcgccacacaggagggtgaccgcggcgatcaccatggcgcggatcacgccggggcgggcgcccagggcgcgggccgcgtcgtcgccgagggccagcgcgttcagcgggcgggcggcggccagcgcgagcaccacgccggccgcgatgaacgcaatgagccggcgcagcgtgtcgaagtcggcgctggccagtgagccgacggtccagaaccgtaccttctggatcgacgcggtgtccgacagcagcaccgcgctgacatacgagtagagcgccgcgttgagggccgccccggccagcgcgagccgggccggggtggccgagcggccgccgcccaccgcgtagaccagcgcggtcaccacggccgcgccggccagggcgaaccagacgtacccggagaacgaggcgacgccgaggaacgcggcggcggtggcgaccgcggccgaggcgccggcattgatcccgagcagtcccgggtcggcgaggggattgcgggtcagcgcctgcatgatcgccccggccaggcccagggcgagacccacgatcaggcccgacagcgtacgcggcaatcgcatctgatgaacgatccggtagtacggcgatgcggggtcgatcaatccggcccagacctcgccgggggtcaggaagcgggctccgaagccgatgccgagcaccagcacgacggcgagcaccgcgaccgcggcgagcagcccgacccagcggacgccggtgcgccggtcggcggcgatgtcgatggtggacagcagagactcccgtcggatccggttgacgcgccttcggctgattaggttagcctaaccatgctccggccgagtggccgggccgctgccctgccgaaagatgtgaccatgcctgtttcgtccctgcccctgtcccgtcgtggcctgctcgcggccggtggtgtcgccgctctcggggcggtgctgaccgcctgtggcacgaaggaggacgccaccgccggcccggccggccaggccgccgcggggccgtggaccttcaccgacgaccagcccaaggcgctccaggcggcgaagacgccgtcgaggatcgtcgccttcaccggcgtcgcggcggccctggccgacctgggcctgcaggaccggatcgtcggcgtcttcggcgaggcccggacccaggccggagacctcgacgtcaccaaggtccaggtcatcggcgacgcgtggggcgagttctcggtcgagaagtacgccgcgctcaccccggacctgctggtcacccacgagttcgacccgggtgcgtactggtacgtgccggacgagtccaaggacaagatcctcgcggtcgcgccgtccgctctgatcaacgtcggccgggtgccgctgaacaaaccgatcgagcggtacgccgatctggccaggtcgctgggtgccgacctgaccgcgcccaaggtgaccgaggccaaggcccgtttcgagaaggccgcccaggacctgggcgacgcggccaaggcgtccggcgggatcaaggtgctgttcggctcgggcagcgcggacatcttctacgtgtccagcgcggacgtcagctccgatctgatgtacttcaagtcgctcggcgtcgacctgatcgtgcccgaggtcgagggcaaggactactacgagtcactgagctgggagaacgccgacaagtaccaggccgacatcatcttcctggacgcccgcaccggcaccctgcagcccaaggacctggccgccaaaccggcctggaacgcactgcccgcggtcaaggcgaaccaggtcttcccgtggcaggccgtgccgatctactcctggaaccacgcggccccgctggtcgaggcgatcaccgccgcgatcaggaagtcgaagaagctgggctgaccgtctccccggaccagtgcagggcgccacggtcggcgagatagcgcacgtgtgccatcgtttcggcgaccgcgccgacccgcatcggcccgatctccgcccacggccgcgaccaggtcaggctcgcggccagcgtccagatcgtcggcgcgccgagcgccgccacggtggccacgatctcgtcgcagcgcgcctcgtggtgctcccgcaactgccgggagcgggccgcgatgccgcggaaccggtactcgtgcgccgggaaggcctccagttcgtcgtgcttggcgacccggtccagcgactccaggaacgactccagcggtgacgagccgggccgctgcaagccgatgttcggactgatccggggcagcaggtgatcgccggtgagcagcaccccggcggccggctccagcaggcagatgtgcccgggcgtgtggcccggcgtccacaccgtggtgaccgtgcgcccggccagcgggatcgggtcgccgtcctgcagcagcacgtcgggctgggccggctcgctcagtcggtgctgcccgatcgtcccggccagcgccgcgatctcgtcctccggcacgtggtgcgcgcgcagccagtcggcgggggagccgccggggtgcagcgcgtcccgctcggcggggtgcatggccacccaggcgcccaggtcctgcagccttttcgacaggccgtgatggtcggagtgcacgtgggtgacgaccacgccccgcacgtcgccggtggtcgcgccggccgcggacaggccggcgtgcagggcggcccagccctcggcgctgtcccagccggggtcgacgacgaccaggccgtcgtcgccggggatcaggtaggacagcgtgtagcgcagcgggctctgcgggatcggcaccgggaccgaccagatgccgccggccaggcgctccaccggggggagcgcgcgcgatcgccatgcttcgagctgcgcctcgccggtcacggtgatcatgtggtcccccattcctagactaattcagtctaggaacgcgaccctatagtgatccggatccgccgagcaacgggaggccgcgcgatgtcagcaaccccacaggcggccaccggccgtccccgcgacccggccgtcgacgagcggatcacccgggccgccgccgaggtcttcggcgagaacgggtggcaccggttcaccatcgacaccgtcgcccggcgggccggggtgggcaaagcctccgtctacctgcgctggcccaacaaggaggcgttgctggcggccgcgctgaccgcgcggctcaacggcatcgaggacatcgacacgggtacggtacgggacgatctgatcagcctcgcgcggcagatccagcggtcctacctgggcgagtccggacgggccgccctgcaactgcgggtcgacgcgcagcgggtgcccgaggtgcgcgaccacctgcaccggctgcaggagtcccaggtgctggcggcgcgggcgatcgtgcgacgggccatcgcccggggtgagttgcgatcggacaccagcgtgaccctgctgctcgactgcgtctgcgggggagtgatgaaccacgtgctggcgaccccgccgcagctgcgcgaccaggtcgcggccggtgccgacgagtacgccgccgccctggtcgacttcgtgctgtcggcggcccgccccgcgccctaggtgaacgcagggagaatcaggatggtcccgccggtgacgttccggaagtgccggatgtcatggaagttcgatgatatccgtcagcaaagtcatgatcgtccaactgcgaaggtccctctggttaggacggtcaacttcgcggcaccgtccgacctcactcctgtgaggtaaatgtgtccagttcccaccgagggaacacctaccggcggcggacgtggccgagtcgccggatgctggcgtacggaaccgtcctgctggtgacggcggccggcctcgcggccccctggtcggcctcgccggccgtcgcggccccggcatcccccgcacgtccggacaaggccgagcgccccgacaaggtgtcggccttcctggcggcgcaggccaccggccgcgacatcctggtgaccggggagacgtcggcgaccaccctgacgtacgtgcgtcccgacggatcgctgcgctccgaggtcacgccggcgcccgtgcgggtcaggcagcgggacggctcctgggccggggtggactaccacctcgtcaaggtcggcggcgggtacgcgccccgggtgtcgcccgcgaacgtggtgttctccgccggtggcgacggccccgcggtgaccctcgacaacggccgccgggccgtcgacctgcgctgggcgaagtcgctgcccgcgccggcgatcagcggcaacagtgccgtctaccagctcaccgacaacgagcagctggtgctgacggcgacctcggacggcttcgaacagtcgttgaagctgctggcccggccggccggcgtgcccaaactgcggctcgggttcgacgccaccggaatgaccatggtcgccgacggcaccggcggctaccggttcgtcgcgaccgaatccggcagagcgacctccaccgtgctctacaccatgccgacgccgcgcatgtactcgtcccaggtgatcaacgaggagcacacgcagatccagcgggtccccgtgacgctggcgaccgacaccgacggcacccagtacgtcgacctcagcgcgggcaagtcgttcctcgacgatccggccaccgtgtacccggtgtggatcgaccccgccgtgtcgtcggtgtcccggtacggtgacacctacgtgaccgaggcggactccgactcgcacgtgtccgacagtgacctgcgcatcggcaactccaccaacggcaacatccggcggtcgctggtgcggttcaacaccaccggcagcatcccggccggcgcccacgtcacctccgcggcgctcaagctctggacgaactactcgggcacctgctcggcgcggtcgatggcggcctacccgatcaccgagaactacacgatgaccagcgcgacctgggcgaaccagccgtcgtactcgacctcgtcggcgtacagcgcgtcgtcgtcgttcgccttcggcaacgaggatctcggctgcgccaacggaaccggcaccgtgccggtgacgaacatggtccaggcctgggtgtcgggcaagctggccgactacggcatgctgctcaaggcgggcagtgagaccgacacgacctacaccaagtacttctgcgcgatgaacgtggacgcgaccggcgcgacgagctgcaccagttcggcgcactatcccaccatgtcggtggtctacaacacctacccgggaacgccgggcagcgtcaccttctccccgcgggtcgccggcaccaccagcgacagcaacaccggcggcgcgcggatcttctcgacctcactgaccccgaagttctccgccaagctcgccaacgccgacggtggcaaggtcaccctgcaggtgaagctgtcgcacgacgtcaacaacaccggcgaaggcaccggcgagatcaccaccttgacctcgaccgcggtgacccccggctcgaccgccacggtggccgtaccggccggcgtgctgaccaacaacacgcacgtgatgtaccagacccgggcacgggtcaccaacggcgcgggcggttacgactactcggcctggacgccggcttcgctgtcggccaccaccgccacgaagttcctgctcaacaccgacacgccggccgagccgtcgattgcctgcggtgcgtacccggccggcacctggaccgcgcaggtcggcgccacgacgtcctgcgcgatcgacacgaccgcggccgacggggccggctactactggggtctggacgacccgtcggccccgaacctggccgccgacagcagcaacaccggcgccgccgtgacggtgtccacgatcgccaccaccccgggctggcacacgctctacgcacggtcccgggacaccgccctgcacctgtccaccggcaccaccgcctacatcttcggggtcggtgcgggcggggtgttgagccccgagccgggtgcctccacggccaagggcgtggccctgtccgcctccaccggctcggcctacaccggggtcacctaccagtgggccgccggcaccaccgggaccacctggaccgacctgccgaccgccgacgtcaccccggccgggtcgtcgacgccgatcacggcgtggccgctgaccggcaccgccgccggcccactggtctccttcaccggatacaactggaacgtggccgcgaccctggccgccgccggtgagccggacggggcactgcgggtgcgggccaggttcaccaccgcgtccgggagcaccggctactcggcggagcgggtcttcaccctcgcggtgaccaccttcgggcagaacgccgccaccagcgacctgggccccggcacggtgtcgctgaccaccggcgacttccaggtgtcggcgggcgactcgtcggtcggtgggctcagcatcggccgtaccgcgacgagcctggtccccgccgccgcctccaacggcccgtccggggtcttcggccccggctggcgggcctcgctgcccggcgcggacgccggcgccggcgacgccgtgctgctcgacaactcggtgtcgggctcggtgaccctccagcacgccgacggtaccgaagcggtctacgtcaagcagtcgtccggcgcctaccggggggtgggcggcgcgaacgacggcaccgtcctgacccggtcgacgtcgatcaccaacccggcggatccggccgacaccaccgcgtacaccggctggcagttgaccgatgccggcggcaccgtcaccacctggaccagaacctcgaccggcatctggacggtggcctggatcgacgagcccggcaaggagggcgagacggcgtacgcccgcgacggcaacggccgggtgaccaccatcctggctccggcgccgaccggcgtcacctgcacgaccggttcgttcaacgcggcgggctgcagcgcgctgcggctgacgtacgccaccggtaccaccgcgtccagcaccgacgaggccggctggggcacctacaacggcctgctgtcgggcgtctcctggaccggttacgacccggctgccgccaccatggtcaccaaaccggtcgcggcctacctctacgactcgaccgggcacctgcgtgccgcctgggacccgcgggacacgaccccgctgaagatccggtacggctacgacgccgccggccggatcgccaccatcacgcccgcgggcctcaacccgtggacgctgagctacgacaaccggggccggctcgccggcgtgtcccgcaacgaccccgcgaacggcgtggccacccgggcggtcgcctacgacctgccggtctccggcctgggcggcgcgcccgacgtctccgggacggccgccgcgggctggggacagaccaccgacctggcgtactcgggagccgcggtcttccccgcgtcccacgtgccggccgccgacaaggccaccggcgcctacgccccggccgcggccgactggccgtacgggtcggtgacgtacgccgacgtcgacggccgcgtcgtcgacgtcgccggatacggcgcgtcggcgtggcagatcgacgccacccgctacgacaccgacggtgacgagatctggtcgctgaccgccggcaaccgcgcccaggccctgagccccaccgcggacaccgacccgtacgtggcgtcgcagagctcctcggcggcccgggccaacctgctggccagcaccagcgtctacgacgcggacggtgtcgacctgctcagcacgctcgggccggcgcatccggcccgactcgccgacgggacggtggcgtcgatccgcctgcggaccgactacacctacgacgccggagcgcccacgaccgacgcgtaccacctggtgaccaggacggtgaccggcccggtggcgctggacggctcggtcaccaccgcggcggacaccaggacgacggtgaccggctacaaccccatcgacggctcatcggcgaccggcaacacgtccggctgggtgctgcacacccccaccacggagaccacctggctgggcagcagcgcctcggcggccgacctgacccggcagacgcggtacgacgccgcgggccgggtggtggagtcccggcttcccggcggctccgccaccgacgccgacaccaccgtcaccacgtactacacgacaggctcgaacacgacctatccggcgtgtggcgggaagccgtcctgggccgggatggtgtgccggaccgatcccggcggcgcgccctcgaccgggtacgcggtgccgtccaaggcctacacgtacaacctgtacgggcagccgctcaccgtcaccgagacctccggtgccgtcgtgcgtaccaccaccaccggctacgacggggtgggccgcagcaccgggaccagcctgagcgtcaccggactgccgggctccgcggcggtcaccgccaccgggcgcacctacgatcccgcgaccgggctgccggccacgacgacccagggttcagcggtgctgaccagcacgtacgacgccatcgggcggcaggccagctacaccgacgccgacggcgcggtgagcacctacgggtacgacctcgacgggcacaccacccgcttcgtggacgtgcgcaccaccacctacacctacgactccggcaccgagcaccgcggcctgctcgtcgggatgaacgccgggatggacaacgccccgtcgaccttcaccgccggctatgacgcggccgggaagatgaccgtgcagtcctacccgaacgggacgaccgccgcctatcacttcgacaacaccggtcagccgacgagcctgtcgtaccagctgcccacctattccggtggcaccgccggcacgatcgagttctccacggtcgccaacccggacgggcagacggtgcacgcgcagtcaccgctgtcggcccaggactacacctacgacaacgccaagcggctcaccgaggtacaggacaccaccgacggctcctgcgtcacccgccggtacgggttcgacaaacagtccgaccggacgagcctggccagctacgcggccaccgccgacgggggctgccagacgacgaccgccgccggcaccagcaccagcacctatgacaccgccaaccggatcaccaccgccggatacacctacgaccagctgggccggaccctcaccgtccccgccgccgggctggcctcgggcagcagcgcgctgaccgtcgcctaccaggacaccgacatgccggtcagcatgacccaggggaccgcgggcaagacgttcaccctggacccggcccgccggtaccggcaggtggtcgacaccacctccggggcggaaaccaggcgcaccgtcaaccactacgccaacaactccgactcaccgtcgtacctcaccgtgtcggcagacggtggcgccaccgccgcctgggcccgcaacatcatcggcctggacggcagactcgcggcggtgcacggctccgacgcggtcgccacgctcgaactgaccaacctgcacggtgacgtcgtcgccaccgtccccgaccaggtgccgaccgccaccgacaccacgggggccagcgccacggcatacttcgagtccaccgaatacggcaccgcccgggacggcacgctgaacgggcgctacaactggctgggcggcgcacagcggtccaccgacgcggtggcgtccctggtcctgatgggcgcgcggctctacaacccggccagcgggcggttcctcaccgtcgacccggtcgccggtggcaaccagaacgcgtacgactatcccagtgatccgatcaactcgttcgacgtcaccggtctcaaacggcacggtggcttctcccggcactggtggggaatcagcctctacctcaccgaatgggcgaccaaccggctgatgcgcggcttcgccgccggatccggggtggcctgggcggccgccgagctcacgtcctggacgggaatcggcggagtgaccggcggggcgatcgcggccctgctcgccgccatgggcggtggcatctggctctgcgactggaacgatcggggcgtcgggttccactacacctatccctggtacggcggtgcgttctggtgctgggcccgatgacgagcactctccgaacggtcgccgtgatctgtggcctgaccggcctcgccctggcgatctgggcattgttcggcgggccgtcgttgttccccggcctgttcctgatcctgctcgccggggggttgagcgccctgtcgcgcggtaggtgacagcagtgcagggttggggccgggccgcacaccagcggcccggcccgagccttgccggccgtcggtggcgaccgtgtggtccgtggcggatcaggccgcggcccccggtgatccgccggagcgacgccgggcccggcgccaccgggtgaccaggaagctgaccaaccagggaaccagcagccaggtcagcacgcagaaaccgccaccgaccacgtcggccagaaagtagccctggtcggtgtcccactgggcgatcacgaaggacgcgacgaaccagatcagcagcagcaacgcggtcagccggccggcggcccgggaccgggcggtgcgcccggcgccgctgagcacccccaggccggccatgacccaaggcatcaggaacagcccgatcgcggtcatcgcgtacatgtagtcggcgcccgggcccaaggagtccacggttgtcacgatggcagggcgccgccatcgatgcacggggcatcctccggcacctcatgggccgtccagcccactccgccgccgcccgccgacgagcccgggcgctgaaacctcacccggtcggccggtccttcttcggcagcgacgccaccaccgcgtcgtaggacgcgtccaccgcttcgaggatctcctcggccgggatcgcaccccgcagccgcagcgtgttccagccgtgccggccgatgtaggcgctggccgtggcatcctccggataccgcgcgagccactcgtcggccaggtcacgtcccttgccgcacttgaccccgaccgtctcgccggtgctgccgagaaacgcgaagatcttcggcccgaccttggccacgacgtcgccctcccacggctggtccggccacgcgcccggcttgtccaggcagtatttcttcagcgtctcggcatccatgatcactccacccccgtgtacgcggcgtaggtgttggccgcccgcgcccgggcctccgcggcatcggtgccggccgcgatgtccgcttccgcccaggcctgcccgctcagccgcatgaacctctgggcatcctcggaagcggtccacgccgcgatcgccgcgttgtcgcgcggcgcgtccggcgccgccacgtgcatcgagagcccgagcagccccatttcccagccgatcccgaccgcacccggtccgaaccggtcccagtgctcgtcgaccggcgcggtgtgctccagggtgaaccgggtccgttcgtccccctccggcgtcagcctgatctcgacccagctcacctgaccggcgaactcccacgtcagggcgaggacatgcggtcggtcacagcgggtgatggtcccgccggcctgcccctcgaactgatacttcccgccctcgcgcaactcaccggagatgggcaggaaccagcgctcgagccgctccgccgtggtcaccacctcccacaggtcgtcgagcccggtgtcgtaaacctggctgatcgtcagcacccgggcctcaccggcttgcagggtgcgccccgccaacgtacgccgggtccggttgatctgctcactggcatcaatcatcgaagctcctgatagtcgtcggaggcgcccggccctccgcggtcggaagcggccggggccggtgggcgtcggacggccgcacggcgtctaccgggatcggccccgggttggtcctcgggggtggcggggcggcgcagtcgatcggccccgggttggtcctcgggggtagcggggcggcgcagtcgatcggccccgggttggtcctcgggggtagccgggcggcgcagtcgttggtcgggagtggttccgggttggtcgtcgggggcggccaagcggcgcagtcgtttgccccgggccacctcggtggccatcgcggcgaggtgcggcgtccagaatcgccggaaccgccccagccactcgtcggcctgtcgcagcgcggtgtcgtccaccgcgtacaaccgcctggctccatccgggcgcaccgtggcgaaaccgttgtctcgcagcaccttgaggtgctgcgagacggcgggctgggagatgccgaactcggcgcggatcaccgcggtcacggcgccggaagtctgctcgccgtccgcgagcacctccatgatccgccgccgcaccggatccccaagcacgtcgaacgcatgcaccagcgcatcctatcaaagttgccttatataagggagctcttttagggatcgacccgtcccaggaggcccgaagaccgggccggggtcagggcccggcccggttcgagcggtccgcacgcaggggagggcggaccggagacggtgaacggtattgctcgtgccccggtggggatggtcaggcgccggtgtcggcggcgcctgaccatcctggtgggaagggtggtcagaagtcgtcgggcgtgcggatccgggagcggatcagctggcccgacggggtgagggcgccggtgccggagaacgccccggcgttgcacgaccccggcttcaggatcgagctgccctccgccttgtcgccgaagttccagttcgcgtaactgatcttcagtttgtccagcaggtcgagccaggcggtggtgccggccgtgtcgaccgccccgtcgccgctggcgctgaccgtgccgaactcggtgacgaacagcgggatcgaggcggccgccttctgcacctcggcgcgatagtcgtccttgtgcgacgcggcgtagaagtggaacgcgtacatgatgttggtggcgttgaccgggttgtcgatgatctccgccgacgaggagccctctgacacgcccagcgacgaccagccgcgggtgccgatgatcacgatgccgtccgggtcgttggcccggatcaccgggatgacctgctcggcgtagctcttgatgccggcccagctgaccccgttgggctcgttggcgatctcgtagatcacgttcttcttggccgcgttgcgcgccgccaccttggcgaagaactccttggcccgggccaggttgaggttcgggtcgcccgggttgaggacgtggaagtcgatcagcgcgtacatcccgtgggcctcggccatgtcgaccaggctgttcaccttggcggtctgcccggtcgggtcggactcgtaaccaccctcctgcacgtacatcgcgatccggaagaggtccgcgttccagtcggtggccagggcgtccatcgccgcaccggtgtagcagccggggaaccagtggatgccgtggctgctcacgccgcgcagctggatcttcttgccgttctggttgcacagtccggcgccgcagaccttgagctgcccgttcgcggccagcggcgtgccgccggcggtggccgtccgggtcggggaagcggtcgtcgcgctcggcttgggggcgcccgtggcggtcgccggcgcgctggtcggcgtcttgcccggcgcgctcgtggcggtcgcggacggcgccccggtcaggccggtgcaggcctgcccgttgaccgtgcacgaggtgggccgcccggttccggtgacgacgaagccgaagctggtcgcgctgccgccggcgatcgtcccgttccagccggccggggtgaacgtgaaggtctggccgccggtcgcgagggtggcgttccacgcctggccgatcgtcgagccggccggcagggtgagctgcaccttccaggtgttgatcttcgaggaggccgggttgctgaccgtgacctcaccctggtagccggtgctccacgagttggtcaccgtgaacgaggcggcctcggcactggccggcagtgcgaagaacgccaccgtgcccacggtagccgcggcgagcgccgaggccaggatcagtttcaagctacgcttcaacgctgcgtcacctttggggaagaatacttgggagcgctcccatatcgaggtggcgactgtaacgtgcccgggaatacgtgtaaacagcgcccccggatcaatcaccccgccgcatcttcgcccagctcacgcttcggtggtcacgttcaatcgcggcgtcatgccgtcgcccggtgtgcgggctgtgtcagcgcggcgcctaccggggtcgccgggggtaccgcctgcgaccggcggccctcgcggatcagtcgcagcgccagagtcggcgcggccgtggctgatgcggggacggtggcacggcggcggccgcggcggcgagggccgtcgcggccaccttcgcatcccgcaggtcggccggatcccgggtcgcctggtggcgtagcagcagcgcctgccactgccgtcgccaggcccgaacggccagctcggtgcccggctcggcgaccaggaccatgcagccgcccgcgtcgacgagcgcatcccagtcgccgaggtcgccggactgttcagcctgctcctggagcagatcgaagagaacaccccacccgatgacgagatcgggatggcccgccggggcctcgtgcagcaggcggtagatctcgtcaatggcgtgctgcaggccccgggggtggcccgagtccgccgtgaacgccacgacgagggccgtgtggatgaactcctcgtcgctcatacccagaacggtagacgtggatacgcgcgggtcaagccctatgtagatttcactccagagcaaccggaaccggacgcagcgtgagtcgcaccgcgatgcccggcgccagctcgcccagctcggtcccgccctcctgcgccacctcccggtgatcaccgggaggtgatcgtgacccggccgatcggccgcgggaagctggccgtcagcacccgccccgatccgtccggatcagggacgatactgatcgactccggtcgcaccagcgccgtggcgatcccgcctgtgtgtggtgcgaccagtggcagccgctcgcccaacacctcgatcacgtcgccttggacggtgccgggcagccggttgctgagacccgcgaaatcggccacgaacgcggtcgcccggcgcagatagatctccgcggggcggcaagctgttcaaacttcccggaacgcatcacagcgacccggcgagtgccttctcccggtcgtgggtgacgaacggggcggaggataggcgtactgcaggaagccggggagcgacattttcgctgctccggggtctcgcgatgaggcgtgcggaggccaggggacggcctcgtgtcgccacctgtggatgacttgatcgagaggatcgctggttcggcggtcatgcagcgaggctacgaagcgctaggtgcagtgcgacacctggcgagcccccgaccttatttgcgggataacccggtgttcgtttcgggggtctgcctggtgttccggccgggctgcgccggcaacactgggcgcatgaacgcaaacgcagcgctcggcatggccgggccgggtcaccgcatcgcggtcagcggctctccaggatctgcttgagccggcccaggtcagcggccacagccgcgatgtccctgtcatacatgtcgtcggtcatcccgacggcacggcgaaccgtgaaaacgatctcggagtggtcgccgtcggcgatcacccggagcggaacgtagacgatcgcaccatcggggaggtgtacttcatgatccagcacaccgaggtcattacggggcacgaataccacctcggcgacgccgccgtccggcacgtcgaccagccagcgtccgtcctccaggcgcacggagccgcccaggccgggcgcccagtgcgcgaggttggccggttccgaggcgtattcatacacgtcccgggcgggacggtcgatgtgctcagccacatgccgggactcggttgccacggctcacatcatcgcatgccacctgatcgctctcgcgttcatcgatgtattcacccctggcggagccatcaccgacgggcacagtccgtatctgtggacctggcatcgttcgaccagtgaaaagcatggatggcgccggccgtggtccggggaggccggccgtggtccggggagaccgaccgggttgggggaacggcgcgtcacggtgaaaggaggccggccggggtggggtacggcgggtcacggtgaaaggaggccggccagggtgggggaacggccgaccacgggtgcggggaggccggccgggacggggtcacggcgatcactggtgggggcaggagcccagggcgaggaggtggctgctgacggcgaccagttcgggttcggtgctgtagaggcgggccaggtggagggcgccctggaagaccgactcggcgtgtgggccgtgctgggcggcctcggcggcgggccagccggggccttcgacgccgtggaccaccacgtcggtgaggccggcctcctggcactcggcggtcagctccgcgatgcggtggaagtaggcgtgggtgaaaccgatcgatgtgtcgttgacgccgtcggtgagcaggcggcgggcctcggccagggtccggtcgtcgaatcgggcggtggcggtgaaatcgaggggaccggcgaaacgactgatggccgcgaccgcgatggggccgccggggcgggtcacccggatggcctcacggatcgcacggatccggtcggcgcggtcgtggaggtggtagagcgggccgaggagcagggtggcgtcctgcgaccggtcgggctcaggcagcgaacgagcatcgccgacgaccgcatcgatcgggggatggccggcccgggcctggtcgacgtgcgccgggaccaggtcgacgaggcggacgtggtgaccgtcggcgaggagctcgcgcgcataagcccccgggccaccgccgacgtcgaggatccgggcgggtgcggcgggcagcacctcgcggagcagttcgagagtgcggatgcgttccagccggctttgcgggcgtcgctccaggcgggtcgcctcctcgtaccgcgtctcgtagtacgtcacgatgtgcgtcgtcgcctcgtccattcaggaatcgtcgcgcccgccggcccaaccggcgaccgattttccacaccccgccctaccggcccgggccggccgggtggtggtctccgtcccggacgcccggacgcccggacgcccggacgcccgggccgagcgggacggcggcgccgaggcggacgtgctggtgccgccggtcgcctcgtgccaccggcacggcatcaccgactcgccccaccgaacccgctccatcggcccgtcgcgtcgggcctattggtcgccccgccagcgttggtttggggaccgcaacgggtctgggcgtcgaactatgacggtcctggcgcagttccgttcctgcagccggtctgggatcaatagcgagagcccagccacttgcaggtggctgggctcggctatcagcgcgtcaggcggccggcgggctgggcaagtgggccacggtcaacggagctgcacgtgtagatcgggtcgccatcgccggttgtgcccgccgtcggccggtgagtcgggtggctggagcggtgggtccgcggatcaggttgttgcggcccgcggcgggaacggaggggcggatcaaagtgttgtggccgccggcgggaacggtggaaccgtggatcaagagttgtgcccgccggcggtgagtgggtcgggtggaggtgggttagcggaccaggtcgtcgccgcggtagagggagttggcgggggtggcggtgcggcgggcggcgcggaggctgccgtccgggtagaagccggttttggtcttggccagggtgaggacggcgtgggtggcggcgtcggcgaactcgttgagagccttcgggttcaggttgttgatgttgtcgcaagcctggtggtagcaggcgtcatagggcttgccggcggtgccgccgtagacggtggcctcctcggcggtcttcacgccctcggcgccgctgaacaggccgccggcggggatgccggcggcgatgaacgggccgtagtcgctgcggccgtcgaacgcggtcggggcggtgggcaggccctgggcggtgaagtaggtggtgaacaggttctcgatctggtcggaaccgtacgggcccgcggtgccggtggcggagccgtcgccgtcgtagacgaagcggacgtagttcggggaggcgaccatgtcgaagttcaggttggcgaagatgtggctcaggtccgtgtcggacaggtgcgacacgtagtaggtggagccgagcaggccggcctcctcggcaccccagaaggcgaaacggaccttctggtgggttttcgtcttcagcttggcgagttggacggcgatctccagatcctgggcggtgccgctgccgtcgtcgttgatgccggggccggggaccaccgagtccaggtgcgagccgaccaccagaacccggttcgggtcaccgccgggatagtcggcgatgatgttgctggtgctggcggcgaggttgatctccgtgttggtctggacccgcacgatgcccggcgcggcggccagggcgctgccgtcggcgaagctcagcgcgacgaccgggatcgccgacgggtcgcccagggtgccctggaacaggtcggtgcggccgggctggccctcgttgaagatgatcgccgcgtcgtagccggcggcggccgcgttcgccgccttgaccgcgaagttgcagccgccacgctggatcagggcgatctgcggggcggtggccgaggcgcgggtgaagtcgccgggggcgcagccggctgtggagctcggcgcgggggtgggcggcagcacgttgttgagggcgggaaccacctggccggtgacgtcgccgctgatcgaataggtgagggtgttcgtcgggtaggccgggccggccggggtgaccggggtgagctgcgccgggctcaggtcgcggaagaacgggaaggtgaacttctgctcggtgacctggtagccggccttcctcagcacgtcaccgacatacgcggcgctggccgcgaagccgggggtgcccgaggcgcgggtcccgccgttctgggtggcgatccgctgcaggacacgttcgtggccgaggatcccggcgacggtgaccgcgtcccgcagcttcttcgtgttgacctcgtcgaccgcccgggccggctgcgggagcagggccagggtcagggcggcggcgaacggaacggcaagggtgcgtttacgcaacaacgtgcttcctccacagtcgacagcaacaccggtatcgatggtgatcagcgcctgcagattaaccgagatgaacaggcgggtggaagcgtccgcgtgtcactctggagaaagccgaaaagcggaggaactccatgcagggcgagatcttcgagtacgcgggcgccaccgtcgagttgctcgacgcgtccacgatcctggccgccgcccgggtgaacccggtcgacctggtgcaccatgcggcggggtggccggccccggtgcagcgggccgaggtgaccgtgtcgagccgggacaccgcggcgggcccggtgcacgtgttcatcgcgcggctgcacgtcggcgccgagccgatgaccaccgagcggatgcgcggactggtgctcggccgggacccgatcggggtgctgctctcgaagcggatcgccgagggggatccggtggccaccaggatcgtggacggggtggggacggcggcggccgcggcgtaccgcaaactgggtttcgaccgcgtcgacaacccggcggcgaaccggcagcccggtgtgctcgcggacgccggggtcggcctgcaggccgaggtgacccacgaggccgccggcgatgtggtgcggctgcgcgccgaggtgccgcgcgacgaggtgaccgcgacccacctgcgggcgttcgtcacgctgaccctgcaggcggtggccgagctggccgacccggacgcgctgcgcgggcggcggttcgtgttcagccgggaggcgaccccgccgccggtgccggtcaccacccaggaggtgaccctggacatggtcggcggtttggccgacgtggtggctcagctgcggcagatcgcggtgtcgttccggcatccggacgcgatggcccgctggggcgcccgccggccgcagggcctgttgatgtacgggccgcccggcaccggcaagaccatgctgtcgcgggcgctggccaacgagatcggcgccgacttccgggagatccgcaccccggagatcctggacaagtggctgggcggttcggagcgcaacatcaagcagatcttccgggacgcccggcggtaccgggtgccgacgctgatgctcttcgacgagttcgattcgatcgtcagctatgccggtgccggcggggacgcggccagtcaggcgctgaacgcggtcgccgggatcttcaagcaggagatgaacgacctgttcgaggcgaacccgaacgtgatcgtggtggccaccacgaacttcccggcccgggtcgacgagtcactgatccgttccggacgcttcgacatcaagatcagcgtgccgaagcccgacgaggtgagccgcgcggagatcttccgcaagatggtcgacgggctggtggcggcgcaccagcggggcgcgttccggatgttcgccgaggacctggacgtggccgcgctcggcgtcgccagcaccgggatgaccggcgccgacatcaaggaggtgctgcgccgggtgcagatgaacaaggccatgcaggacgcccggaccggtgccgccgacccgatcacccagcaggagctgctcaccgaggtgcgcaacctgcggggcagcgtctgacggcgtggccgccggacgcccgcggtggtgacgcgtggcccccgttcgggccacaccgggcgggccggccgccggcacggcctgccggcggcgaaccggcccggttgtcagtgcggagcggcccgctcgacgatcgccgcggtgtcggcgccggtcggcagtgtgccgaacgtgtggccccagtcgccggcgagccggctggcgcagaacgcgtcggcgaccgcggacggcgcgtgccggaccagcaacgagccttgcagggtcagtgccatgcgttcgaccagccgccgcgcccggacctcgacatcggtccggtcggtcagctctctgcgcaggtcacggacggcgctgtcgaggcggtggtcggcgctgcgggcggcgtccacctcggcgaagaaggcttccaggctgtccggtgagcgctgcagggcgcgcagcacgtcgagagcctgcacgttgcccgacccctcccagatcgagttgagcggggcgtcgcggtagagccggggcagcccggaatcctcgacgtagccgttgccgcccaggcactccagggcctcgccgaccacggccggctgccgcttgcagacccagaacttgccgaccgggatggccagccgccggaacgcgtcctcccgccggtcgaccgccccggccagccgcatcgccagcagcgtggccgcctcggattcgatcgccaggtcggccaggacggcgcgcatcgccggcttgtcgacgaggggcccgccgaacgccgaccggtgctcggcgtggtggatcgcctgcacgagggcggcgcgcatcccggaggccgagccgatcacgcagtccagccgggtcatcgacaccatctcgatgatggtccggacgccctggccctcgccgccgaccagccaggcgacggtgccgtcgaactccggctcgctggaggcgttgctgcggttgcccagcttgtccttgagccgctggatccggaacgtgttgcgggtgccgtccggcaggatccgcgggacgaggaagcaggacagcccgcccggcgcctgcgcgaggaccaggaacaggtcgcacatcggcgcgctggtgaaccacttgtggccggtcagccgccaggtgccggcgcccgtggcggtcgctgtggtcgtgttggcccgcacgtccgagccaccctgcttctcggtcatgcccatcccggcgagcagaccgctcttggcggccggggtgcgcaggcccgggtcgtacgaccggctggtcagcgatggttcgtagagcgctgccaggtcagggttgttgcgcagggccgggaccaccgcgtaggtcatcgagatcgggcagccgtgcccggcctccggctgcgaccagacgaagaagctcgccgcccgggccacgtgcgcgccgggtcgcggatcggcccacgcggcgccggccagtcccgcgccgaccgcgacctccatcagacggtgccaggacgggtggaagtcgacctcgtcaatgcggtgcccgtaccggtcgtgggtgagcagccgcggctcgtgccggttcgcctcctcggcccaccgctgaacctgctcactgcccgccagtgaaccgagtttgtgcaggtcgtcggtgtgccagccggctccctcccgggccagggccgcggtcagcgcggcgtcggcggcgacgtcgaatccggtgagcggcggtggctggttgaacacctcgtgggtcacgccggcaccctactacccggtaaccgggaacgggaggtccgacaattgcctaatgtgagagtgtgacccctttccagcgattcgtcgtctggctgcgggtgcccggccggatcccgctgctcagcctgatcgccgtcatcctggccgtcacctatgtcccgctgtgggtggtcaccatccgttccttcgacaacctggagcagcgcgagaacgtggacgaggccgaggagttgcgcgtcgctcccggcgcccagttgcagcggctcagcgacttcgggatgaccaacgcgatctggaccgcgctgtacgacgacatccggcgtggtgatcaggcgcatttcgcgatcgacgtgccgggttcggtggtcggtccgcggtacggcatgaccgcggtgatcggcacggacctgaccggcgaggtccgggtcggcggggcgatcgacggatcggcctacaccgcgctgccgggcgccctgcgcgagccgtcgacgctgcgcacgctgttcgacccgggcgcctcggcggacaccgggaagtgcggcttcaccagcgtgaccggcgcgcccaccgagttctgcggcttcccggcatacccggacgccggcactccgggcggtccgtccggcggtctgctgctgttccgcgagctcaacgccgccgcgctcgccgagatcaccgagaagaccaacgaccgattgacggtacgggcacagccgcgccccggccgcgagcacggcagcctgaccgcctcgtacgggccgatcggcgtgcgcaccgcggtggtcgacacggcggagagcaccgagcggatcaccgcgacgctgggcgcgctgaccgcgtcggccaccgaggtgtcccgggcggtggccaccatgaccgacaccatcggcagcgtgcgggcggcgatcgggcaggtccgcacggtcgccgacggtcagcagcacaccatcagcgggctgatgaaccaggtgcagaacgcgatcgggcagatcgaggatctgggggaccggcagcagccggccggcgggggcgggtcggacctggagctcttctagcagctcttgttgtgcacgcccaggcacgggttgtggccgatcgcgtcgttgacccgctcgctgatctggcgcagctgccggtactgcgtgggggtgagcgcgtcgatcagcagccggcgcacctcggcgacgtggcccggggcggtggccaccaccttgtcccagccggcgtcggtgagcacggcgagcgtgtagcgcccgtcggtcgggtcgggctcgcggtagagccagcccttggactccaggcggcgggcggtgtgcgagaggcgggacagcgagcaggcgctgaactcggcgagctcgctcatccgggccttgcgcccgggtttcatcgagacgccggcgagcacctgatattcgaagaaggagaggccggcggtctgctgcagatcggcgtcgagggcggccgggaaccgggtcagcatcttgatcatggcgagccaggtggcctcctcctcggcctgcagccagcgcggctcgtcggtgctcatggtcaccaccttagcttgacgcctcaactctgcctgtgatgcttctgacttgacggttcaagtcacgagcgcctaccttgagttgacggttcaagtccgacagcaacgggagcagtaccgatgagcattcttcgtatcgacgccagcatcctcggcccgaactccgcgagcagcgagctcgccgacatcgccgaggccgcgtggctcgagacggcgccggacaccaaggtcgtgcggcgtcacatcggcaacgagccgctgccgtcgcacgcgtggcagctcgccacctcggccggctacgtccccgaggccgaccggtcgcaggcgatgaacgacgcggtcgccctggccaacgagctcgccgcggagttacgcgacgccgacggcgccatcctggccctgccgttctacaactacggcgtctcccagcacgtcaagacctggttcgacctggccatggccggtggtgagcagggcgagaagttcctcgacggcaagccggtcatcgtggtcacctcccgcggcggcgcgtacggcccgggcaccccgcgcgagggctgggaccacaacaccgactacctgcgccgcgtcatcggcgacatctggggcgccgacctgatcctcatcgagcgcgagttcaccctggtcggcctgaacccggcgctggaccagttcaaggacgtcgccgccgagatgaaggccgccgcccacgcggccgccgccgaggccggccgggcgcacgccgcccgctgaccccgtccccgggtccccgccgcgcatcgcggcggggacccggggtataagcggctgatgcagtcgctcggagtacgcaccacccaggccgtcggcgccgcgctcggcctgctcgtgccgttcggcgggatcgccgccctggtcgccggcaaatggtccggcctgcgtgagatcgacacgcaggtcgccgaccggttgcacgaggcagcgctcggccacgccgccctggtcgatgcgctggcctggtggagcctggccttcgacccgaacacctggcgggccgccgccctggtcctggcgatctggctggtccgccgccgggaacggatgctcgcctggtgggtggtggccaccatggccgccgggggagcgctcggcggcgtgctcaaactcctcttcggacgccaccggcccgacctgctcgacccggtcgcccgggccaccggatactcgttcccgtccgggcacgctctcaacaacgcactgggcgccgccgtcttcctgctggtgctgctgccccgcacccgcggccgggcgaaacgcgccgcgctggtcaccgcggccgtcgccatcccgttgatcaccgcgtacacccgggtcgcgctcggtgtgcactggaccagtgacgtggtcgccggcctgctgctcggggcggccgtaccggcgatcaccgtcgccgtgttccagagacgccgcgttcgggtagaaggcggccgtgtccagattcgttaaacaggcgttcacccggatcgtgctgccggtcgccgcgatcctgctgctgatgatcgggctcggggtgctgctcacccacgtgctcaaggacgagaacgggttcaaccgcaccctcgaacacgaccgcaccccggagttgacccacatctcctcgttcttcagcagcgtgggcaacaccatgacgatcatcgccgtcaccgcggtggccgcgctgatcctgcgcctcaccctgcaccgctggcgcgaaccgctgttcctctgcctcgcggtcaccgcccaggccgtggtcttcttcttcaccaccctggccatcgaccgcccgcgtcccgacgtccaccgtctcgacgcctccccgcccacctccagcttcccgtccgggcacacctcggcggcgttcgccctctacgtcggcctcgccgtcgtcctggcctcgctcgcgcgtcccggctggctcaaagccctctgctggctgctcgtcctcgtaccgctcgcggtcgccaccgcccgcatgtaccgcggcatgcaccacccgagcgacgtgctgtccgcctgcctcaactcgaccctgtgcctcaccgtgatgggccgcgccatcctcaaccgcgacgtcccctggcgacgcgccgggatcggatccgcggcaccggcgggcacgctgcagccggccggaaacggcgcagaatcgacggcgacctcctgaagcggatgtcgcccgccgcggccgatcactgaccgctgctcaccggtggacccgtgttgtcgcccggctcgtcagagccgggtggcatccgggccgtccggtcactcccgccgcgcccgccatccgcgggtgggcaccggacggtggacgtgttcgcccgccggtcaggacgggtaggggagctgggtggcggcgagttcctcccagcgggcgcggagttcggcgaccaggtcggggtgcttctgggccaggtcggcctgctcgcgggggtcgtggtcaaggtcgaagagctggtcggtgtcggtgtcgcgcagatacttccagttgccgcggcgcagggcgcgggactgccgggtgcgccagaacaggtcgtgtcccggcgccggcgaaccgtgcagcaggtagccggcgaaactggtgccgtccagcggataggccggatcgggggcggcgccggcgatctccagcagggtggccgtccagtccggggtgacgaccggttcgtggctgacctggccgccgtggatccgggccggccagcggacgatcgtcggcacccggataccgccctcgttcaggctggccttggtgccggtcagcggccactgataggagtaccgctcgccgccgttgtcactggagaagatcaccagggtgttctcctcctgaccggtctgccgcagcgcgctgagcacctgcccgacccggacgtccaggttctccaccatcttcctgtacgtttccagcgagccgccgtcggtgtggaacagcgcgaacgtgtcgccggcccgcacccgggcggtgatctcggcgctgaccgcgcggtcgccgggcgcctcccacggccagtgcgggctggtgaaattcaggttcagcagccacggcgcgcggtgctcacggcgcaggaacgcctccgcccggtgcgccagcgtgtcggtgtagtactcgtcggactcgacccgcgtctcaccctcgaacaggtcgacaccctgcccggtgatcttcgagtagtagtcgaccgcgcccgaatagttgccgaagaactcgtcccaacccgaacgcagcggcccgaaccagggcaggaaaccgttgtgccacttgccgaacatggcggtcgtgtagccggccttcttcagcagcgaggcgagcgtcggatgctccggcggcagaccggcggtcgggctcggcgcggcgatcggctcgggcagaccgccgggaagccggcccggataccgtccggtgtagagcgacatgcgggtcggcgagcagaccgcgccaccggagtaggcctgggtgaaacggacacccgaactcgccaggcgatcgaggttcggcgtcttgatgtccggagagccgtagctgctcaggtcggcccagccgagatcgtccgcgaagatgaacaggatgttcggtcgctgcgccggcttcgaggaggcggcggcctggaaggggcgttcggcggcctcggccggctccgtgggcagggtggtcgcggcggcggcaccggccagggcgctgaagaccccgcgccgggtggtcccacggttcgtcacatcgtctcctgtggatcggtgtcgacgcgccgagattacccactgagtcgataggagtaaaggtacgtctcgggccgtgccgggaaggcggcggtgaccagggaggcgaggccggcgagcagcagggcggcgccggccgcacgccaggggccggggtcggtcacgacctcgtcgtcgggcacgatgacggcggccggtaccggccggtggttcatgacgggccagaagtgcccgggcggctgtgtccgggcctgctccgccccggcccgctccagctggtccatcatgacgtcgggttcccacgcccggggtcccggatccccgtgcagccggtcggcgcgcacctgatcgaggacgaacgggctgatggaggcttgcagcggcgcccaagaggcgaagttcgggtcggtgacgacgggcgcattcagggcgtcggtggtgccgatcgtgaacagcgctccgatcagggtcccgaggaccggcagcaggccgatggcggcggcggcgttgcggcgcgggccggccagtgcggcggtgatcgccaggccggccgcggacagcgtcatcgcggtcacggtgagcagggacgtccgggccgggctggcggtggtcaggaaatcggtctcgctcagcttcgcggccgcggcggcggtgagcacggtgaaagcggcggccggcagcagcttgacgaggcgggggaggccggggccggcgtggggaggcagcccggagcgcaggagcaggccgatggccagagcggctccgccggcgacgatcaggagctcgcgggggagccacggcatcagggagtcgtcgttgcccacggtggcgtcggccagcggatcggcgacggagaaggccgcggccagcaacaacaggcccgcgatggtccagcgtcgcgggacggtccaggtcgtcgtattgatgacggcgtacgcgacgagcgctcccatggcgaccagctcggccaggggcaggagcgggtggccgacctgccacaggccggtgatcaggaggctggcgccggtggcgaaggtcagggccggccagttcgcagtacgcatcactgacatggtgcgcaaaacgggcaccgactggcatcggcgaaagggcgaggtgggtggccggacggttgatggcgccggcggttgcggtgggtggccggacggatgacggcggccgcggtcgacggtcggacggcggatggcgacggcacgctgggggaacacggcgggccgcgccgccgtgccactcagcccggccgcgggcgtcaggctccggtcaccgggaagatgatcgcgtcgccggtcttccaggcgcagctgtccgccggggcgccgtcgggctggtagaagaccctgaggtggtagccgccggcggccgccgacagcacgaaccaccaggggcagccgccggccggcttggtggccgagaacaggccggcggttcgtttgtcgggctgccaaccggagcgttgcgccagatcggcatagaacgcgcggaccgtgccgctcgacgccagcccggagaggtgggcgccgaccacgtccgcggccggcatctccaggcccgcaccgccgccgccgcacgtcatcgactcctccaccgcatcgtcgaggtcggtggcgtgtgggtgctgccggagcaccgggtcctcggtgatggcgtggaccgtgtccggtctggcggtgcagccgttcaggctggccggtggattcccctggtagaacgcgatccccacgagaaccgcgaagaccaggacgggcccaccgagcacccgcgcccagccccagaacgtcataggcttttccatcggcggtgatcatagggcccgccggtcgcggcgcgaacggctcccgtgtcacgagcacggaccggctggcccggtgtgccggcggtgacgctgactctacggcgacggcagtgggggcgacgctgactacggcgacggcagtgggggtgacgctgactacggcggcggcagtgggggtgaccgcggcggcgtcggcattacggcgtcggcagagatggtgactacggcggggcggggcggctacgtcgacgggcgcggggtggggtgaggagatcctcgggtgtgggaatggggcggggtgggcgcgggaccggtgcggggcgcgacagcatgggggcatgacgaagctgagtgggcgggagatcgcggagcgggcgccgggtgggtgggtctacctgctgggggtgctgcggacccggctgcggaccggggacttcgccaccgggctggcgctggtcgacgcgatcggggcggtggccgaggagatggatcaccatccggatctggatctgcggtacgggttcgtggacgtgcggaccagcagccacgacgtgggtgcggtgaccgggcgggacctgcgactggctcaggcgatctcggagctggccggcagagccggggtggcgctcgacccggccggactgggtgggctcgaatgggcgctggacactcccgcggcgaacggggtggcgccgttctgggcggcggtgctcgggatgcggcagcaggaccacgacggggtcaacgacgaggtgcgcgatccgtccgggacgctgccggcgatctggttccagcggtccgggagcgaggagccgcggcagcgctggcatcccgacgtgtggatcgacccgagcgaggtgccgacgcggatcgatgcggcggtcgcggcgggcgggacgctggtgagtgacgcgaacgcgccgagcttctgggtgctcgccgaccccgaggggaacaaggtctgcctctgcacctggcaggaccgcggctgagcccggcgcggcgtgttccggggtttgcgggtgaaacggtgaccacgcacggacagtgaagacatcccatgtgccaggggtgtcaagcggcttggtcgaggtggtgtgcccaggcggtggtttcgttgtagggggtgctggttttgaggcagccgtggaggatgccgacgaggcggttggcgagttgtcgcagggcgggtcggtggccgatgccgcgggtgcgttgcctgtcgtagtaggcgcgggcgccgggtgaggcgcgtagcgcggtgaaggcttggccctgcagggcgtcggcgagccggtcgttgtgcacgtagcgggccatgacgcgtgcagccgggcgatacccgccacaccctccggcaaccgcgccttggccagccgccgccccgaaccatccatcaactcgacgtcgtgatggtcctcggcccagtcatcacccacgaacagcaacacgctctcccgtccacgaccagcaacgacgcgggcctgcagccggcaggagaaccatcagcgacctaatgaaccagtgctcaaaggcacgacatcccatcagcgattctgttctcccagccgaccggcggcggcacggtcttcactaagaactcccacgttcagaggacgtcagtgctcatccgccggcggctacctacccgccagaagcttgccggatccggcagctcctagcactcattagagggcggcgatcgctctggacgcgcagcggccagatcgccggcctcggcccgcgcgggagcatacggtctgcaccccggcggcggcgcgtccccgaaaggtcttgttctccgaagcgggaaagggccggcgtccccggtgggacgccggcccttccgcagatcgcggcgaagcggggcaggtcggagggctgccccgcttcgcctcatcactcaggccgcgacagtagccctcgtgacgaccggagccgacccgcccgacaggtgccgtaggtatgccggcagggtcaggaactccgggcacgtccgttcggtgagcaggaccgtgaggagcgtgcgggcctggccgaagagccgggccgcctcctcgtccagcgcaccggtctcgctgagcacgtccagctcctcgcggagcatccgggtgaccatggcggccgtgaccgggacgccgtagtcggtgggggtgcccgacgagatccactgccagagctgggcccggcagatctccgcggtggcggcgtcctccatgagtccgccgagcgcgaccgcgccgcggccgcccagccaggaggcgatgtaacgcagcgagacgctgatgttgttgcgcagcgcgacctcgccgacggcgaccgcggtggccttcacatcgaggagttccgcggcgccgacccgcacgtcgtcgcgcttgcggacgatctggtgcggctcgtcgccgagccactggtcgaagacctcgcggcaggtctcgaccagcgcggggtgcgccacccaggagccgtcgaagccgtcgccgacctcgcggcgcttgtcctggcggacctggttgagggcacgcttggcggcgaccgggtcacggctggggacgaccgcggccatcccgccgatcgcgtgggcaccgcgccggtggcacgtcttgaccagcagttcggtgtaggcccgcatgaacggcgcggtcatggtgacctgggaccgctcgggcaggaccacgtccggccggttcttgatcatgctgaacaggtagtcccagcggccggcgttgagacccgccgagtgctcgcgcagctcgtagaggatctcgtccatctcgaaggccgcgttgatcgtctcgatcagcacggtggcccggatcgtgccgcgcgggatgccgagctgctcctgggcgaagacgaagacgtcgttccagaggcgggcctccaggtgcgactccagcttcggcaggtagaagtacgggccggaaccccggtcgatctgccgctgcccgcagtggaacaggtacagaccgaagtcgaacagcgacgcggagaccgcgcggccgccgatccgcaggtggcactcgggcaggtgccagccgcgcgggcggaccatgatggtgggcaggtcggcgcccacctcgtaccggcggccgtcgggggccgtccagtcgagagtgccgtccagcgcgtccttcaggttgacctggccgaggatcacgttctcccaggtgggagaggtggcgtcctcgaagtcggccatccagaccttggcgccggagttcagcgcgttgatggtcattttgcgctcgggcgggccggtgatctcgacgcggcggtcgcgcaggtccgcggccggggccgccacctgccacgacgcgtcgtcgcggatggcccgggtggagggcaggaagtccaggtccgtggtgcgggtggcccggcggcgccggcggcgctccagcagctgcacccgccgggcaccgaactcccggtccagtgccaccacgaacgcgacggcctcgggggtcagaatctcggagtatcggtctgcggtggttccggtgatggtgatctcttcggcacccatgatcagatctccctgccctctcacatgctcagatcagaactgctcggcctcggtgctgccggacagcgccgtggtggacgactcggggttgagggcggtggagacggcgtcgaagtaaccggtgccgacctcggcctggtgcttggtggcggtgtaaccgtcggcctcggccgcgaactccgcctcctgcagcttcacgtaggcggtcatgccgctctccgcgtagcccttggccagctcgaacatcgagtggttgagagcgtggaagccggccagggtgacgaactggaacttgtaccccatcgcgcccagctccttctggaagcgggcgatgtcggcgtcgtccaggttcttcttccagttgaacgacggcgagcagttgtacgacagcagcttgccggggtgcaccgcgtgcacggcctcggcgaacttgcgggcgaactcgaggtccggcttgccggtctcgacccacagcatgtcggcgtagtcggcgtaggcgatgccgcgggcgatcgccgcgtcgtcgcccggggtgacccggtagaagccctcggcggtgcgctcgccggtgacgaacggcttgtcacgctcgtccacgtcggaggtgagcaggtccgccgcgagagcgtcggtacgggcgatgaccagcgacgggacgccggccacgtcggccgccaggcgcgccgcgttcagggtgcggatgtgctgctgggtcgggatcagcaccttgccgcccaggtggccgcacttcttctcgctggccagctggtcctcccagtgcacgcccgccgcgccggccgcgatcatggccttcatcagctcgaacgcgttgagcgggccaccgaagccggcctccgcgtcggcgacgatcggggcgaaccagtcacgctcgtacttgccgttcgaggtgtcgatctggtcggcgcgcagcagcgcgttgttgatccgccggaccaccgcgggcaccgagttcgccgggtacagcgactggtccgggtaggtgtggccggacaggttcgcgtccgccgcgacctgccagccggacaggtagatcgccttgaggccggcgcgcaccatctgggtcgcctggccgccggtcagtgaacccagcgcgttgatgtagtcctcggtgtgcagcagctcccacagcttggccgcgccacgctcggcaagcgtgtgccgctcctgcagggtgccccgcagcttgacgacgtcctcggcggtgtaggtgcgcttgacacccgcccaccgggggtcgctggcccacgcctgagtgaggtccgcagcggtaccgcccctggtttcggcaagctcagtcatcagaaagtccctctttcgtgccctgtcgcgttgttccgtttggaacaacttcaccctcagggatcacaccagcccctcagaaggcctttcctgcgagaagaagtgaaaaaattctgttaagctaaaacccgtgaccgcttcaccttctgactccgtcgatctcgtcactctcgggcagcgtctgcggcatttgcggcgcacccgcggcatgacgctggaccagctcagtgaggcggtaggccgggcaccctcccagctgtcgctgatcgagaacggcaagcgggagccgaaactctccgtgctgcaggcgatcgcggcggcgctcggcgtccccatgcaggacctgctgcgcgcggaggcgccctcgcggcgggccgcgctggagatcgagctgacccatctacagcagaatccggtttattccgcgctgggcctgccggtggtcaagggcggccggcggctgccgcccgacgccctcgagtcgctgatcgggctgcaccgcgagctgaaccgggtgctcaccgagcagagcgccacccccgaggtggcccgccgcgccaacgcgcaactccgcgctgacatgcgcaaacgcaacaactacttcgccgacatcgaggccgcggccaacaagatcctgctttccgtacggcatgccaccggcccgctgtcgcaacgcgggatcctggacgtcgccgcccaggtggggttcacgctgcactacgtgaacgacctgccgacctcgacgcggtcggtcaccgacctgaagaatcgccgaatttatctgccgcaggtggccagcgggaagggccacgacccgcgcggcgtggtgctgcagaccctcggccacttcgtgctcggccacaacgacccggccgactacggcgacttcctgcgccagcgggtcgaggtcaactacttcgcggcggcgctgctgatgccggagaagttcgccgtcgacttcctggccgccgccaaggccgaccgggccctggcgatcgacgacttccgggacgcgttcggggtcagctacgagaccgcggcgcaccggttcaccaacctggccacccaccacttcgggatcccggtgcacttcgcccgggtgcacgagagcgggatcgtctacaaggcgtacgagaacgacaacgtgcgcttcccgtccgacgtcaccggggcgatcgaggggcagccggtgtgtcgcaagtgggcgtcccggacggtgttcgaggccgacgatccgtactcgtcgttctaccagttcaccgacaccacggcgggcacctactggtgcacggtgcatgtcgagtcgacccggtccggggagttctcggtgaccgtcgggacgccgtacgagcacgcccgttggttccgcggcggggacgtctccgggcgcaccgtctccacctgccccgacccggactgttgccgccggccgccggcgcaactggtggaccgctgggcgggcaacgcgtggcccagcgcccgggtgcactcgcatctgctggccgcgctgccgccgggcaccttcccgggggtggacaaccgggacgtctacgacttcctggagcggcggaccggttcctagagttctccccgccacggccggaatcgccggcgggtggtcgcggggtcgggacatgcagcggttgccgggtcgttgacgacgaggcgatcgtgcgggaactgctcggcgaggcgctgcggtgcggcggctgcgcgccggcgggcggaagattccattcttttcctttccgccaaggacgccgccgccgtcctcacccgcttcaccgccgcggcggtcatcatcgtgatcacgggcgccctgctcgtcgcggtcttcgccatcctggccacgaccaccgcggtcccgccgactccccgccgtcgtcacccgccagcgccgggatgtgtgagccggccctcctcgacggtgagggccaggaactcgccggtggtccaggccaccgtcaggcccgcctggccggcttcggcgatcacgtcgtcctcggtggcgatccacgaccgccgggacacgctccgctcgtccaggatcctgccgtggcgcagtacccggtacgtgtcggtgtaggtgatcgactcgtggtccgcgggtgcgcacgcgaaccagcgctcgtaggtgcagtcgccgaccgtggtgcggcaggccaggcgttcctcgacccgcatcgtcgccgtgctgccgtagtgccggtcgacgacagccggagcgccgggcgcgaggtggccggcgagcagccgccacaggtcggcgcgctgagccggggccagctgacacaccaggtggacggcgacggccgcaccccacacccccggcaggtcggcggtgaacaggtcgccgggcagcaccgtgatccgctgccgcaacgactcgtcgtaggcgatccgcgagaacaggacggcgcgcatcgccgccgacttctcgaccgcgaccatccggtggtgcgggaaactcccggccagtcgcagcgtgccgagtccggtgccgcagcccagatcgacgatcggaagatcgggccgcgggtggcgcaccgcatcggcgagtgtggccaggatgcccgcaccggactcctgcgcccgcatcaggtcggtgaactcggccagcgtcacatcgtcgtcggtcgtgcccgcctgatgccgggtctgctcgtcgtcggtcgtgcccgcctgatgccgggtctgctcgtcgtcggtcatgcgcgcatcgtgccagggcggcggacggccggcacccggtagcgcgggtcgggccggcgccgctgccggccgggcgacgcggacacgatcggcgtcgtagtcgatcacctgtggagcccgggccgccggccgggcagaggcaggggccggggcgggactggacggggcggagccgcctttcccctgcgccgcgccgggctggttcaggcctttgccgggaacggccggttggtgcggatcaggccggcgttgcggtcggcgatcgccatccggaagtaccagaaggcgccgagcggggtcatgaccacgctgttgaacagggtgtacagcggcatcagggcgagccagcgggtgcgcaccggccagtgcatgtagacgatcagggcgctgtgcaggccgaagatggccagcagggtccagccgccggtggccagggtgagccagcgcagcgggaagccggccagggtgatcacgctgccgtacagccagaagaaggggtggcggaacagcaggtgcgcgttgacggcgaagagccggaactcgccgccggaccaggccaggcgctggcggtaccaggctttgaaggtttccgggacgctggtggcgacgtggaacggcaggtggccgacgcgcaggccgagggcgccggcgagcaggcccgcctcgacgtcgttgccctggaagaacagcgagtggcggcgcatcacctcgcggtgcgcctcggtgcgggccacgtgacaggcgccggagacctgccagggtgcgatgatccgcaacttcatcgcggtgcggtactcgtaggcctgcaggcggcccagggcactgcggtcgttggtcggcaccaggggcaccgacgcgaagtcgtacccgttggcgacgagctggccgaccagctcgccgaacgggcgctcggtggtggtgtcggcgtcgatgcagacgacgtacggggtgtgcaccgccacctcgagcgcgtcccggaccaggcggtcgcggatggtgccggaggtggcccgcttgccgccggccccggcgccgccggccaccccggcggcgcggaagatccggaagccgtgccgctcggcgatcccgcccagcccggcgtagaactcggcggactcgccgtcggtcgtgcacagcaccacccggccgccgtactgggccagatagtcgacgttctccagataccgcaccgagccgtagatcgggaccaggacggtgaagtcctggaccggctcggcgccggccggcaccgggcgggccaggcccgcccggatcagggtggcccggtcgatcagcacccagagcaccgggatgaccaggaaggagaaggcgaggacggcccaggcggccgggtggatggtcatcgagcgcccgtgctcagcggctggcccgcaccgaccgggaagtcgacgccggccgcgtcgcgcagcagggagcgcagctcggcgcggagccggtcctcgtcgtgctcggcgaggcgctcggcgagcatggcgacgtcgtacagcagaccgcggtcggccgccccgtacgaggtgaccgtcgagatccgcggatgcccggtggtgcccagcatctcgatcccgtcgtgcagctcctcgtgcagcttctcgcccggccgcagcccggtgtagacgatctccggctcggtgcgcagcgcggcggccatccggcggaccacgtcctcgatcagcatcggctcgcccatgtccagcacgtacgtctcgccggccgaggccatctgcccggcctcgacgaccagcgcggcggcctccgggatggtcatgaagtagcgggtgacggccgggtcggtgatggtcaccggcaggttgttgctcagctgccagtgcagggtcggcaggaacgagccgcggctgcccagcacgttgccgaaccggaccgaggcgacccgcatcgcgtcgccggcccacgccgaggtgacccgttcggcgatccgcttggtggcgcccagcacgctggtcggggcggcggccttgtcggtggagatgttcacgaacacccgcacgccggcccgggccgcggcgcgcaccacgttcgccgtaccgaggatgttggtcttgatgccctccgccgggtagcgctccagcagcggcaggtgcttgtgcgcggcggcgtggaagaccaggtccggccggatccgtgcgaacagccggtcgagcacctgctcgtcgcggatgtcggcgagcacgacgctgtcgttgtcgagcaggccgtggccgagcagctccagctgcagggcgtgcagggcgccctcgtcgtggtcgaggaggaacacctgggaggcgttgagccggtgcacctggcgcacgatctcgctgccgatcgagccacccgcgccggtgaccagcaccgagcggccctcgaccgacacctgggtggccgggctgaacaggggttcggtgtgcttgccgagcagccgtgccagcgtggccgggttcggggtgttctgcatgggtttgtcatccctcagggtgtccccagggacgtcggtttcgccactggctccccgtcaggcctcggcgaccaaatcgcctgacggttcacagcctcgcccgcggcaccctcggtgccgccccaagatcttgcgaaatgcccgacttatctgtcaagccggacttaatcacaccggcggcatcaggcatcggcgaccttaaattaccttaacaatctttactgttaacaagacttaatttactttgatgaacacgtcgtcccctgtggcctcacaaggagcaacttatgagacgtcgattcaccctgcccgccctgaccgtcgcggcggtcgccggatcgctgttcgtggccgtcaccccggcgttcgcgcacggctacatctcctcaccaccgagccgtcaggccaactgcgccagcggcgcggtgaccggctgcggcgacatcgtctatgaaccgcagagcgtggaagcaccgaagggttcgacgcagtgcaacggaggcggcagccgtttcaccgtgttgaacgacaacagcaagagctggccggccgccacggtcgggcagacggtcaccttcaactgggtgctcaccgcgcggcactcgaccgcgacctgggaatacttcattggcaacacgctgctggcgtcgttcaacgacggcggagcgcaaccgggggcgaccaagtcgcacacggtgagcatgaaaggcttcaccgggcggcagaccgtgctggcccggtggaacatcgcggacacggtcaacgcgttctactcctgcgtggacctgaacatcaccggcgggtcgacgacgcccacgccgaccccgaccccgacgcccacacccacgccgacggtctcgccgtcgccgaccaccccgccgcccacgtcgggcaccacgacctgggcggcaggcacgacgtacaaagccggcgatgttgtcgtttatgccggtaggtcgtatcagtgccggcaggcacacaccgcgatcaacggctgggagccgccgaacgtgccggctctgtggaccgcgctgtaaccatgtcgtcgacgatgacaccgagcggcccggttcgccgggccgcctcggccctgctgctgaccgccgccctcctgggtggctgcaccgccggcaccacctccgcagccccggccccgtcgggtgcggtcaacgacgtggacgtcatgttcctgcagatgggcctcgcccagatcgccgagggtgaccgggtcgccgcgctggccgagcagcacgccggcaacccggagatcggccggatcgccggggagctgcgcggccagtggcggaccgagggcggcaccatgcagcgctggctgctcgggtggtcgcagccgaccgccgccgacccgtcggccggcgcgcacgccgggcacggtgacctgcacgccctgcgcgaatccgacttcaccgacctggccgcgcggcacggcgccgacttcgaccgcaccgcggtcggcatgctgctcggcaccctgcacaacggcatggagacgctgcgcctggagtccgccgcgggggcatacccgccggcccgcgccctggccaccaggatgaccggcgagcggcagtcccagatccagcgcctgctacggctcgccgcgggctgagccgtgagcaccgtcccggcatgcccgaaccgatcgtgcccaccgcgcgcccgcggaccggccggctcgaagcccgcgacgagggccgtggcggtgtcctggagggcatcctggacacccacatcggacggctccgacgtcactggatcacgctctcctgaaccggcacccgcgaccgggccggccgggtcgacagccagcagccggcgatgatcagcgcgaacccggcgatcgtgccggcgccgatcccctcgtgcagcagaaccaccccgagcagcgccgccaccaccgggttgacgtaggtgaccaggcccgcccggttcgacccggccagcccgatgagctgatagaaggcgagcagcgccaccgccgtgcagaacaggccgagcgcggccagagcggcccacgaatcggcgccgacgtggtggtgcggcagctggaaggcggccagcggcagcagcacgaggctggcgaccgtggtgtcggcggcggtcagcgcgtccggtgggacgtcgctcagccggtcctggaccagcttcgtggcgaacgcgtagctgatcgcggccagcagcaccatgcccgcgccgagcagaccccaccggtcacccgacaggtccagcccgaccagcaccacgaccccggcgaatccactgatcagaccggtgacccgcagcccggtgagcggctcggaaccggacatcagcagggcgatcaccaccggctcgacggcgatcaggatcccggtcagcgacgagctgatgtgctgctcgccgtacgtgatgagcaggaacggcccgatgatgtggaccgccgcgagcagcacgaccgggcgccatcggccgcgcagcgccgaaaggctgccgcgcgacgcggcgatcgggatcagcgccgcggcgccgatcgcgcaccggccggccaccaccagcagcggcgacagatcctcgatggcgatcttgatgaggaagtacgggatcccccacagcacggagaccaggacgaacaacagccaggcacgacgattcacaaccccagaatcgtcccgtacggtcgtaagcggtagtgctgacttcgagaagccgtcataaggagaactgatgatcgactcccggcggctgcaggtgctctccgaggtggccaggcacggcagcttcaaccgcgccgccgccgagctgagactcaccccgtccgccgtgtcccagcagatcagcgctctggagcggtccctgggcacccccgtggtgcggcgcagcacccggggcgtcgcgctgaccgaggccggcctggtgctgatcgacgccgcccaggcgatcaccgccgagctgcgcaccgcccagcgcgagatcgaccggctcgccaccgcccgcaccgagcggctcaccgtggccaccttcaccagcggcggccagcggctgctgccacccgcgctgacccggttcaccgccgagcacccgggcgtcgagctgaccgtgatcgagagcgagccggaggacagcctgcccctggtccgttcgggcgcggccgagctcgccctggcctaccacttcaccggtccgccaccggtcgtcggcggcgaccggtccggcctgctctggacaccgatcctggacgacccgatgtggatcgtcctgcccgccggccaccccctggccggcgccgccacgctcggcctgaccgacctggccggggaacgctgggtgtacggctgccccgggcagagcgacctgctggagcactacgccgcgctggagggcctcagcgtccgggtggcctgccgcggcaccgactaccagttcgcgcagtccctggtccgggccggggtgggcatcagcatgatccccgaggtggggctctcgcaggaccgggccggtctggtggcggtgccgatgcgaccacccggcccgtgccggtacgtgggcgtggcgaccccgcggcggcggccgtcaccgctggccacggccctgctggcgacgctgcgggaggtggtcgtggcgctgccgccgaacccgttgaccactccggggtgatcaccggcagccggttgcgccaaccgggcccgccaaccggcccggccgcctagcgtcggaggaatgacgaagtccggaccggtggtgggcctgctggtcacggccgccctcacgctgcccaccgcggcgccggcggtggccgctccggtgcccaccggctgcggcgaagcctgtgaccagcaggacccgcagacctacaacacgtgcggcgccggctgcccggacaacgtcccgcagcactgcgccgacgaggccgtcaccccgcacgtctcggcgcgcggctgggtcgagctgcgctacagcgccacctgccgcaccgtctggtcccgcgtcggcgccgccttcccggcccacgccgaacactggaccgagacccgctactccaacggccgcctgcgcctggcgaccaccccgaccacgcagacctggtccccgatgctctccgacgccgacctggccggccgggcctgcgccgccactctcggcccgtccggccggcacctcatcatggactgcaccccctggttctgagccgacccgcgcccgtccgacgacggcggacgggcgcgggtcggcgcgggaatcggctgtccgtcaggtgacgatgcggtgttcccaggcccaggcggcgacctcgacccggttccgcaggccgatcttggactgcacgctgcccaggtgggtcttgaccgtgcccaccgagatgaacagctcggtggcgatctccgcgttggtccggccccgggcgatcagccgcaccacctcgagctcgcgcggtgacaggccgccgtcgtcggtggacggcgcgggctgggacaggtgctccagcagacgtaccgtgatcgaggggctgatcagcgcgtcgccggagtgggccgcgcgcaccgcctcgatgagcagcgccggccccgcgtccttgagcaggaagccgcaggccccgttgcgcagcgcctggtggacgtattcgtcgaggtcgaacgtggtgaccatgaccaccttgaccgggtcgacgacgccggggccggccagcagccgcagcgcctgcagaccgtccatcttcggcatccggatgtcgaagagcgcgacgtcggggcgcaggcggcgggccgcctcgacggcctccacgccgtccgcggcctcgccgaccacctccatgtcgggctgcgcgccgatgatcatcccgaagccggtgcggaccatcgcctggtcgtcagccacgagcacacggatcactgagcatttccccttacggaatcgggaagacggcgtcgaccacccagccaccgtcgacgccggggccggagctgatccggccgccggcggcgcggacccgttcggtcagcccgaccagaccgtaccccggccggtcgagggtcgggcgcggggccgggccgtcgttggccacccggatcagcaactggtcgcggagccggcggacccagatgtcgacggcggtggcctgcggcgcgtgctgccgggtgttggtcagcgcctccatcaccacccggtacgccgaggtggagacctcgaccggcaggccgtgcgggtcgccgtcgaggtgcagccgggccggggggccgccggccgcggtgaactggtccgcgagggcggcgagttcgggcactccggcgaccggggcgagcggcgcgtccgggcgggactgcgggtcgcgcagcacgccgaccatccggcgcatcgaggtcatcgtctcggtgccggcctgttcgatctgttcgagggcgagcagcacccgtttcgggtcctgttcggcgatgaaccgggcgccctgcgcctgcaccacgatgccggtgacgtggtgggcgatgaagtcgtgcaggtcgcgggcgaattcggcgcgctgttcggcgcggaccgtgtcgagggcccgctgccggttgccggcggtgatccgcagggtgacgccgaagccgatcgcgccggccgcaccgagcgcctggatcaggcagaacgtcccgtagatggtgctgtgcccggagcgcagcggcatcacgctgaccgccgcgccggtggcgaccagggccagcaccgcccagtcgggccgggcgttgcgggcgaccagggtcagggtgatcagcagcgcggtcgattcggccaggccccacagtccgccgtacggatcggtgaccgccagccccgcggtgaccagcagcgacgcgccggcggcggcgatcgcggcggtgggcagcaggatcgacccgggtttgtagtgcggcagccagaccgcggcggcgccgatcgcgagcgccacctggatcgggaacagcgggctctcggtcatgcttccggtcacgtcgacgatgccgagcagggccatcagccccagcccggccacctgcaggaagcccagaagtatgcggttcatcgtgacccagcgtaggcggcccggtgcgggatctgatcggccgaaagttagacccgggccgccgggaacccggtccgagagcggatgtgggggttgcggtgatccatcaggattctctcgtccggttcccagcttccttggagctttccatgcagacgcagtcctcacctctggccggccgcgacgccctcgcggcggtcgcggccgttgacctggtgaaggtgtacgggaccggggacaccgcggtccgcgccctcgacggggtcaccgtcggtttcgaacgctcccggttcaccgcgatcatgggcccgtccggctccggcaagtccaccctgatgcactgcctggccggcctggacacggccacctccgggcaggtgctgctcggcggcagcgacctgaccaagcagtccgaccgggtgctgacgaaggtgcgccgggagcggatcggcttcgtcttccagtcgttcaacctgctgccgcagctgaccgcggccggcaacatcacgctgccgctcgacctggccggccggaagccggacgccgagctgtacgaccggctggtcaccacgctcggcctggccggccgcctcgggcacctgcccagcgagctctccggcggccagcagcagcgggtggcgctggcccgggcgctggtctcccggccggaggtgctcttcgccgacgagccgaccggcaacctggactcccgctccggcgccgaggtgctcggtctgctgcgcgactcggtgcgccagctggggcagacgatcgtgatggtgacccacgacccgggtgccgcggcctacgccgaccgggtggtgctgctcgccgacgggcagctggccggggagatccggaacccggacatcgcgtcggtcaccgacgcgctgcagaagctggcggccggccggtgaacacgattctgcgtacgcagatggccggtgccgcccgtcgccccgcccggctgctgctcaccggtctggccgtgctcgtcgcgtcgttcgtggtctacgccaccgtgctggcccgcgacatcaccgagcgcagcgttctggacgggctcagcggcaccccggagacggtcgacctgatcgtccgcaacggcgcactgaacgacaagcagctggcccagatcaccgccctgcccggggtggccggcacggccgcgcgcaccgaggtcggcggccagctgggcgggcagtacctgagcatcaccgcggacccgggcagtggcccgctcgccctggtgaaggtcgcccaggggcgctatccgagcgcgcccggcgagatcgcgatcaccccgcgcaccgtgcagctgctcggcctgtcgatcggctcgaccgtcggcgtcgacccgggcagcggcaggaaggtgccgctcaaagtggtcggtgtggtcgacccgccgcacgacttcggcggcgacgcgtacgccccgtcgaacaccgtgatcgggctgaccccggagccctacctgcagcagatcgacatcgacgtggccgccggggccgacgccgggccgatccaggagaagatccaggcgatgttcgccggcgccaagcaggaggaccggccggaggtggccacgggggccgacgtccggctggaggaggcccgccaggcggcgagccagatcgattccctgttcgcggtggtcggcatgttcgtcgggatcgcggtcgccgcggccggactgatcgcggccagcacgttccggatcgtcttcgcccagcggatgcgtcagctggcgctgctgcgggcgatcggtgcgggccgcggcgcgacgttccgggcgctggccgccgagggcgcgctcaccggcctggtcaccggcacgaccggggtgctggccgggcaggcggccggcttcgggatcccggcgctgctgcgcggcttcggctggaaggtgcagaacccggggatcccggtcctctgggcgatcggcaccatcctgctggccgtggtgatctcggtggtcgcggtactcgccccggcggtctcggcggcccgggtggcgcccctcgaggcgctgcgcgccgcggccgggaccggcgcccgcaccgggatcggggtgctgcgctggatcggcggcctgctgccgctggcgggcgcgctggcgctggccggttacgtgatggtcaacctgcccaagccggatcagaaggattacgacgcgcagaccatgctgctggccgtggtcgcctccggcgcgctggccttcgtggcgctgatcgcgctgggcccggtgctggtccggccggtgctggcggtggccggctggccgctgcggcgactcggcccggtcggccggctggccgtcggcggggtgggcggcagcgcccgtcgggccgcggcggtctcggtggtggtcgcgctgggtgtcaccctggtcgccggggtgctggtcggcggcgcgtcggtccgggcgctcggcgagcgggagctggccgcctcggcaccggccgacttcgagctgaccggtggggacggggtgaccgtgccggccgagatggtcgccaaggcgaaggcgagcggcgagctgacccgggtcgtggcgtaccggcggctggccgcggccagcatcggcgacatcgatcacgtggcggtcaccgacctggacgtgccgtcggtgccgaggctggcggatctcgacgtccgctcgggctcgctcgccgacctcgcgcccggcaaggcggtgatctccagcttcaccgcggagtccgccggcgccggtgtgggtggtcaggtgaccgtggcgaacggcgcgaagaaggtcaccttcaccgtggcggcggtgctcggcgacgacgcgccgctgcacgccagcctgctggtcaccccggcggacctgaccgcgctgggcgcgggcgccacgttcaacgggatcctggcggacgcggcgcacgacggcgagagcggccggaccgaggcgctgcgggcgatccgcgcggtcgccggcggtcagggcgactacagcgtgaccgtgctcgccgaccagcgtgacgagctgaactcggagctggcgacgctgctcgggatcgcgctcggactgatcggcctgaccgtgctgatcgcggtggtcggggtcggcgccaccaccgcgctgtcggtggtcgagcgggtccgcgagtcgggtctgctgcgggcgatcggcatgtcccgcggcgcgctgcgcaccatgctgaccgccgagtcggccctgtacggggtgatcggtgcggtgctcggcctgctgctcggggtgccctacgcctggctggcgatccaggcgatcggtgtgaacgcgccgctcgcggtgcccggctggcagctcgccggcgccttcctggccctggtggcgctgaccggggcggccggggtgctgccggcccggcgggccgcgaaggtcagcccggtgaccgcgctgggcaccgagtaacgaccggctcagccggagcggcgggcctggccccgccgctccggaccgggcggcccgtccgccgggggcaggctgaaccggaacgtcgcaccctgaccctcctcaccctcggcgcggatctccccgccgtgccgctcgatcgcccggtgcacggtggtcagcccgatcccggtgcccgggaagtcgcgcgcgtcgtgcaggcgggcgaacgggcggaacagctccccggccttgccggccgggaaaccggccccgttgtcgcggacgaagtaggtgtcgtccgcgaagccgacggtgatcaccggacgctcgaccttgcgggtgaacttcaccgcgttgttgaccaggttctccaggatgacccggaccaggccctcgtcggcgtccgcggtcatcccctcctgaacctggaagtcgaccttgtggtccggatcccgggcggccacctcggcgcacacctgccgggccgtggcggtcatgtcgaatcgcgcccggcgcagctcgccgcggctggctcgggccaggatcagcagcgactcgaccaggtcggccatccgcagcgcggccgcgtggatccggccgagccggtgccgggtctgctcacccagctgctcgtcgtccgcctcgtccagcatgtgctcggcgaaactgctgatcacctgcagcgggccgcgcaggtcgtgggaaaccgaaccggagaacgcctcgagctcccggttgcgccactccagctcctcgaccatcgcggcccgggtctcggccagctgccgggccgcccgctcctcggcggcgtccagctcgcggcgcatcagctcctcacggatccgccgcgcctcgtcgtgggactgcttgcggcggatctgcgcccgcacgtgcacccgcagcccctccgggacgtcggacgagcgcacgtagtcgtcggcgcccgcggccaggcactccagcatgtggtcctcgcgcccgacgaccaccaccgggatgtcgcccacctgcggcacctcgcgcacccgccggcaggccgcctgggccgcggccaggtcgtggtcgaacccgagcaccatgcagtcggccggctgctcgccgagcagcgccagggcttcggtgacgtcccggcaggcgacgatgtcgtacccgtcggtgcgcagcgcctccgcccagcactcctgctcgtcgcggtccggggtcacggtgagcaccttgccggggccgtgcaggccgccgatcccctcgatcggcagctgctcggccgattgccgcagcaccgcggccagcttggccagcaccaccgcgagatcctgctgcttgcgcacgaacgcgtcggccccggcgtcgagcatctgcatctcggtggcgtagtcgtcggccgccgtcatcagcaggcacggggtgtcgcgcagcgccgggtcgagccggatccggcggatcaccgtggccccgtcgacgcccggcatcaccccgtcgacgatcaccgcgtccggccggcggtcggcggccatccgcaggccctcctcaccgccggaggcggtcagcaccgtgtacccctccggctccagcagctcgcgcagccgctcccggaacgtcatgctgtcgtcgatcaccaggatggccggcgccccgcccgcggcccggccggacggctgcccgccgagcagctgccgggtgcgggccaccacgtacccggcgtcgtacggcttgccgatgtactcgtcggcgccgatccgcagcccggccagccggtcggacacgtcgctctccaccgacagcagcatcgtcaccacgttcgcgtgcccggccgaggcgcgcagctcggtgagcagttccaggccgtccgcgtcgggcagcagcacgtcgagcaccgccgcgtcgaactcggcgcgggtgaacgcctcgcgggcctcggcgccggtcgcgcacaggatggtggtgaacccgtcgtcggtgaacgcgtcgtggagatccatccggacggtcaggctgtcgtcgacgatcaggacggtcggggtcatcggcggatcaccaccggctgcagctcggccagccgggccgcgatccgcgccggcggcagcacgtgcatggcggcgccgagcagcgcggcctcccgcggcatgccgtacaccgtgcagctgtgctcgtcctgggcgaaggtgatcgccccgcggtggcgcatctgcagcagcccggccgcgccgtcgcggcccatcccggtcagcaggcagccggccgccaggttgccgtactcggtggccaccgactcgaagagcacgtcgaccgagggccggcaggagtgccggggcggcccgtcggacaggcgcagcacgtggtcgcggacgtacaggtgccggtccggcggggcgagcagcacctgaccggtcagcgtgcgcaccggggtgccgtcggtggcgtaccgcacgttgcgcccggtctgcccggccagccagtcggagaacgccacggcgaactgctcgctggccgcgatgtgctgcacgcacagcaccgggggccggaagttcggcggcaggctgcgcagcagctcggtgagcgcggccgggccgccggtcgaggcaccgaccgcgatcagcgtcatcgcgttcgccgggtgcggcatggtcgcggccggggtcggtggcagcgacggtgaggccgcgcgggcccggccgtccagccgggcccgcgggtgggtgatcacccggatccgggagaccatccgcagcgtccggcgcagccgcggggcccagtcggcgtccgagtcgtcgccgcgcggtttctccatcacgtcgaccgcgcccgcggccagcgcgttgtacgtgctgaacaactcctgccggtcggccgaggagaccaccaggatcggcgtcgggtgctcggccatgatgtgctcggtggcctgcagtccgctgatcccgggcagcatcatgtccatggtgatcacgtcggggcgcagccggccggtcagcgtgaccgcctgctcgccggtcaccgcctcgccgaccacctccagctccgggtcctcggtcagcgcctcgcgcaggtggtagcgcatggtcgcggagtcctcgaccaccagcacccggatcatgcgcgcaccaccaggcggcggatgtgccccagaagctcctcctgatcgaattcgcccttgaccacgtaggcgctggctccggcccggatgccgcggtcgcggtcggccgcactggcccgggagctgaccaggatggccgggacggcggcgagctccgggtcggcccgggtccgctcgacgaaggtgaagccgtcgatgccgggcatgtcgatgtcggtgaggaacagcccgtaccgccgggagcgggcccgctccaggccctcctcgccggaggcggccaggtcgacctcgtaaccggccgactccaggatgctgcgctccagcatccgggtggtcagcgagtcgtcgacgaccaagatcggcagcggcggcgtgaccggggcgacggccgggcgacccgcggtggccgggtcgtgcaccatctcccggatcagcccgtccgggtcgagcaccagccgtggattgccctcgctgtcgatcgacacgctgctgatcaccggggtggtcggggccagttcgggcaggaaccgggcgaccagggaatgcgtgccgagcagtcgatccacgccgaccgccgcggcgccctggtcgccgtgcagcaccacggcggcgcccggcccggccgcgtccggcgccggccgcccgacgcccagcgcctcgatcagcggctggtacggcatcgccacatgctggtggaccagccggccgctgccggccgcggtctccgcctccgccgggctcagccgcacgcaggcacgtaccgcgtccagcggcagtgaggcggtcaccccgcccgcctcgatcagcaggcccgtcatgctcagcagggccagcggcaccaccagctcgacgctcgccccggcccccggggtgctgcggatccgcacctcgccgcggagctgggcggcgacgtcgcgcagcacgtccatcccgatcgcccggccggccacctcggtgaccgtcgccgacgtgctgatcccgccgtgcagcaccaggtcgaggacctcggcgtcggccggcccggcgcccggcagcagcccgcgggcctgcgcctggtgccgcagcgcggccacgtcgaagccgcgcccgtcgtcggtgcagcggaaggtcgcgtaccggccctgccgttccacctcgaaggtgaccgtgccctccgccggtttcccggccgccgcccgctccgtggctggctccaccccgtgcaccaccgcgttgcggaccacgtgcagaaacgccgagctggccgggccgagcaggtgcgagcccatccgcacgtcggcgccgtgggtgacgaaccggacctgcttgccctcggtgtccgcggcgtcgcggaccgcccggcgcagcgcggtgaagatgctcccggccggcaccagccgcagactctccgccttggcccggacgtcgtccagctcccgttcgatctggtcgaccgcgtcgctgagccgccggccggccgagcccagctcgccggccagccgccgggccgaggcgtgcgtgaccgcggccgcggtccggccgccgcgcagctgatcggcgagcgtctcggcgctggtccgcagcttctcgacgacgcggctgccggcccgcagcggggccatccgggcggtggtctcggtgatcgcgtcgagcaggtcgtccagatcggcggtcgccgcccggggcgccacggtctccgccaccggctccgcccgaggttccggggcgacctccacggcgggcgtggccaccacggcgggcgtggtctccagggcgggcgtggtctccacgaccgggggtggcgccggtggccgggtcagcgcggtcacctgcgcgctgatctcgtcgttgagccgcagcagttcccgcatgtccccggcggccagcccggccgcgtcctcccggtgcgcgaccaggatctcctcgaactcgtgcgcccggtcggcgatctccttctgccggaccacccgggccgcgcccttgagcgtgtgcgcggcccgcagcagccgggccaccggctccgccccgcgctgctggtccaggtcgagcaccccggcgctgatctgctcgaccaactcctgcgcctcgatccggaagtagcgcaacgggtcgcggctctcggccatctcagtggctccgggtcccgaccagctccagcaggtcgccggagagggtgctcaggtgcgccgcggtctgcttggtctgcaccgcgctgctctcggtctcccgggacacccgggcggtgtccgacaccgccaggttgacctgctccaccgcggtggtctgctgcttggtggagagctcgatctcccgggtggcgtcgttggtggtggacaccagctgggcgatctcccggaacgagttggtcgcctcgtcgaactgccgggcgccggcgtcgaccgccttggcgccgatctcggtggccatcaccgtggtgttcaccgcgccgcgcacgtcgtcgatcagcgcccggatctccttggctgaggcggccgtgcggtcggccagcttgcggatctcctcggccaccacggcgaaccggcgaccccactcgccggccccgctggcctcgatggtcgcgttgatcgccaggatgttggtctgctcggccagctccgacaccaggtcgacgaccccgccgatctgctgcgacttctcgcccagcgccagcatgtgctggacgatctggtcgacctgggtgcggatcgcggtgatcgaggcccgggtctggtcgatggtggcgtccccggtgcgggccgccgcctcggtctcctcggcgatctgggacacccgctgcgcgctgtccgcgatctgccgggaggtgatcagcagttcgttgatcgtggtggtgatctcgttgatcgcgctggcctggtcccggccaccgttgacctgctgggcggcggccgcctccagctgggccgacgagctctggatgtgcccgaccgcggcgcccacctcgcggcgcaggtcccggctcaggcgccaggccaccatgaccgcgctggccgtggtgagcgcgccgagcccgacgatcaccgcgatcgccaggttcgcctgccgcgacgagtgccggcggtcggcctcgacgtcggagcgcaccgtggcgatcaggtcggcgagggtcgcctgcacctgtctgcgcagcggcatcgcctgagtgttgttgagcgccgccgcggccagcggatccttcgtctgggtccgcttctgcatcaccacgtcgacccattcggcgtgcttggcctcggcgtcggcggtctgcttgagcaacgccttgaccgccgtactggagtcgttctgcaggtcggcgagctgggcgaggaagtcggcgcggtcctgcccggtggcggtggcgaactcgtcgcttccgtagagcatgaagccccggtagtcgcccagccgtttctccatcagccggttcaggttctccgcgccggtcagctcgtgggtcgccgcggcgatcacccggtccttggcgtgcaccacgaacagcaggcagagggtggagaccaccaccgacagcagggtgagcaggccggtcagcccgactccgaagccgagcttccggccgaacgtctggccgtccatcatgaggacacctccgggtgttcgtgcccggccatccggtgggccaggacgcgggtggccggcacgtcgacgatcggccggtcgccgtccggcagccgcaccatcccgcgcaggcagccccgggacgacgccgccccggaaccgtcgacgacgtcggcggacggcacccggacgtggtggtcgagctggtggaaggcgagcgccagcggcgggctcccggcggccagcaccagccagcgcggctgctcggcgatcgggtggccgagcagcgcggccaggtcgtacaccgggaccaccacgccggcgaacccggccaggccgcgcagcgccgggacggtggtcggcagcggggtgaccggccggttcgggtacaggcccgaggtctgtgacaggcgcagcgcgtacgcccggccaccgaccccgaccgcgagcagctccaccgactcgtcgtccagggtgcgcagcggcaccgcgaacgagtggtcgaactcggcccgcagccgttcgacccgggacagcacccggtcggtcaccgccgtgccccgtcccgctcggcccggcagaggacactcagcgtgagccgcccgaacccgccgccgaacagggtgatccgctcctcggactcgcgcggcagcaggtccagcgcggcggtcagctcggccgcggcggccgtctcgtcgccctcgcgccgggccagcagccccagccgcagccggggcatcgcgaacccgggatcgagataggcggccagccggtactgcgcggccgcctgatccggttcgtcgatctcccggcacagcccgagcagctggtgcgcgtccggctgcggagcgccggcgtcgatcaggcgggtggccacggcggccgcctccgggagccgcccgagctgggcgagcagcacgccgtacagcagcggatgctgcgacgacaccggggcgagcaggtcgagggcctcggcgaaccgctcgtcccgcagaagatcaagggctcgcgagcggatttccggcgtacgcggtgaccgcacccgtggcggcggcgcgacccgcggcggcgcggcccggggcgcgggctgcggggtgggcgctgcgatgctgcggcggtagaacaccgtgtcgccgtggtgttccacggtgaagcccggcggggcgctgcccagcgagtcggtgtgcccgaggaacagcgcgccgccgtcggccagcgagccggtgatccggtccagcacgccgcggaccgtcgccggggtcaggtacatcagcaggttgcggcagaacaccgcgtcgtaccggccgggctgccagatccgtggatcctccggcccggccacgttgtgctcgacgaactgcaccgagccggtgatctcccgggccacctcgtagccgtccgggaccgaccggaaccagcggctccgcacgtccggcggggtctcccgcagcgaccactcggagtagaccgcccgccgggcccggcgcagcacctccgggttcgcgtcgacgccgagcaccgcgacgatccagtccggggccggtcgcacccggtgcgccacgatcgccagcgagtacgcctcttcgccggacgagcagccgaccgagagcatccgcagcacccgctggccggcccgggcctcgatccgctgcggcagcacccgggaggcgagcgcccggaactggtcgccgtgccggaagaagtacgtctcggtgatgctgagccgctcggccaggatcacggtctcctccggccaggcccggccggccagccgatccaggtaggcggattcggtcagctggcgggcggccgcgcgttcggcgaggaccggcaggaccggcaccgcctcggtgtcggcggcggcccagccgagccgccgctccaggatttcccggaatcgcaccaggggcggctcgccgctcacccggtcgctccggtgtcgtgtgccgcgaccgcctgcgcggtgcccggctccgcggtgtcccggtcgcggccggcggcgtcccagacctcgtccgggacggtgcggatgctgcgcagcaccagcagcggctcggtgccgaccgtgccgaccgccgcgaccagtgagcgggatgctccggtgaacagcgtgctcggaccctccggcgggaccgcgtgcacggtccgcacgcccagcaccggcccggtcgcacaggccaccggaccgcgtccggcgtgcaccgcaacgtaccgatcgatcccggacgacacgccggtcagcaaccgggtcatgtcgatcaccggggcgggctcgccgcgcaggatcgtcaggccccggacataggacggggtgccggccagcgggcgggtcggcagcggccgcatggtctcgatgacctcggcgaggggcagcgcacagaaaagcggaccggcctggaagaccagcgcgatcgttccggcctcgcccgccggagcctgtcgtagctgccccacgggttcaggctagccatccgccgcgtccatttcgcgagcttcgctcgcttcgcccagacctttccgtgccgcgggcggcccggttcgggccggctccggcgagcggccgcccaccgcgtccgccggagccggcggctcactccttgtccgcccaccaggtcgggatcagcgactccggctggcgtttcgccttccgggacagacggccccgggacgggcgttcccgcttctcggtggaggcgccggcgctctccgtactgtgccgggcggccggcggacgccgcccggcgaccggggtgccctcccggccggcgtcggtccctagctagctaggagcgggggcggtcggcgcggggtcggcggccgccgggatggcggtgtccggccacagccgcgggcggcggcgggcggccagatcctcggcccagccgaagagcagcaccgcgaccgcggtcagcgtcatcgtcatcccgagggtgaccggcttctccaggtggcccaggtcgtcggcggtcaggaagctgaggaccggccagacggcggcgatggccaggttgtgccagaggtacacggtgaccgcccgggcgttgagcagggtgaccgcgcggtccagcaggttggtccgggacagccaggtcatgctcggctgccagcgcagcgccagcagcacgaaggccagggagtacagcgactgcgactcggagacgtcgttcaggtcccacggatcgtcaccctggtggccgctctggtagtacagcccggcgcaggacagcgtcacgaacaggaacacgaccgtggccggggcgagtctgcggagccggccgtcgcggtgggcgaaaccggtgatccagcaggcggcgtaggtgacgaagtcccacatcaccacgtcggcggtctccggcagctcgaagccggtcttgtcgagcgccacgatggccaggatcggggcgatcaccagcagccagcaggccggacccagcttcttccagaggaaccacaggaccggggagagcaggatgaaccagacgtaggcccggatgtaccagagtggttcccaggcgtcgacggcgagctcgctgcccgggggatcgccgagcggcaggatccagaacgccagcttccacaccttgaacgggtgctcgcccccgtgttcccgggaccagcccagagcgatcatcaccggcacggcgagcaggccgagcagccacaggggaggcaccagccggcgcacccgggaggtgaccacgtcccgggccgggcgccgctccagcgacgccgcggtcagcgagccggccagggcgaacatgacgcccatggcgggcatcacgatggacagccacgaccagccgaacaggtggtagacgatcacccggacgatcgccgcggcacggagcagatccaggtatcggttgcgcaccggggaaccgtagccacgcggaacgcgcatccggcagggtcgatcggttggcaagaaggccgtaccggattaccccgatagcgggaactgtgtccgattccagtgcgattgtgcgacgtgtgtgcatcgcggttgcgtccctttgggctggtcacggcgtacgcgtcaagagtcctctatgtggcggtggccgcccgcggatccggcgggcagtgaccgcctcgcgcctgtgacgttggtcaaccccgggagcgtcccggcacagggcggggcgcgctatggaatggatcgactctcgttatgcgtaagccttcggttgtgctctccgtggctaccgcggccctggtcgccggtggtgtcgccacgacacgcgcgctggcgcaggagccgccggatgtcgccggcttcacgatcttcggcggtcccgtgacgtccgacgcgtcgccggcgccggacgatgccggcccggatcccgcggccgggttggggaccgcgccggccacgatcccggcccgcgtgatcacccgcaagccggccgccgagcccaccgcggagcccaccgccgagccggccgtcgaacccgggccgatcaaggcggtcgccccgaagaagaactacggcttcgccgccgcggccgacccgatcgccgcctcgcacaccgaggtgaccgtggaaagtatctcgtccagcccgtacgccccggtccagcagcagatcctggccctggtcaacctccagcgggggcgggccggctgccgaccggtcaccatcgaccgccggctgatcgacgcggccaacggccacgccgccgagatggcccgccgcgactacttcgaccacgcctcgccgaacggcaagggggccggggaccgggtcagtgcgaacggctacccgtggcgcttgtacggcgagaacatcgcccgcggccagcgcagcccgtgggaggcgatggacgcctggatgaacagcccggagcatcgggccaacatcctcgactgcaagctcgaccagatgggggtcggcctggccatcgacggcggccacaccccctactgggtgcaggacttcgccagcccccagtagcttccgcaaaccctccccggagcactcaagacggaaaccgggctgccgatggcatcccggtttcatgtcacggttccgttcgctgatcgttttcgcggacccgctgtgcttcgatgtgcgcacgacactcctggggaggatgtgatgtggcagtgaaacgtgttagcgcacgtctcacgacggcggccctggccgccatggtgggcggcgggctgggcgcgttcgccgtgacgccggcgagtgccggcgccgccgtgcggaccacgccggtggccacctcggtggtcacccgggcggccgcttcgtcgtgtgccaccggtaggtaccagaagcaggttgagacgtatctcaagcagctcggcggatacggcacggtgaccgtcgacggcaggcagtcggccgccgactgtgccgcgatcgtccggttccagaagcggttcggcatccagccggcccagggcctggccgggccgaccaccgtcgacgtggccaagcggctcgcctcgacgaagatcgcggcctgcaagccgaaccggaagggcatcaccttctgcgtcgatctgaccaaccagacgacgtgggtgatgaagaacgggaagctgttcgtcaagccgaccatcacccggaccggcatgaagggctaccacacgccggccggcaccttcaagatcaacaagcggacgccgaaggagtggtccgacccgtaccacgtctggctgccctactggcagcgcttcatcggcgggcgtggcttccaccagaccaccacgtacctccacgacaagtggcgtgggtcgcacggctgcgtcaacctgctgccgcaggacgcgaagcagtactacggcatcggcacgatcggcatgaccgtcaaggtgttcgggcgtcgccccggcacctgatcgtcgcatcgacgagacgggccgctcccgaacggtgggggcggcccgttcggtgtttcccgacatagagtgtgctctgtgtcccggaccccctcccgcagcgcgctgatcaccggcggcaccgcggtgctcctgctgctcaccgccgcgtcctgcaaggacgacaacgccggggtccacctcggcaccgccaccatcggcacggtcgacgagatcgtcgaggcgcccggctcggtcaccgcccgcggcgccgccaccctcaccgcgccggccgccggcaccgtcaccgacctgcgcgtccagcccggcgaccgggtgaagaagggcgacgtgctggcggtcatcgactccccggagctgcggcagcgccgggacgccgcccgccgggccctggcgcagaccccgtccggcggcggtggcggagtctcggccggcaacttcacccaggtccgccggagcaccgaccggcaggccgggcaggcgttccaggacgcgctcacggccgccgaccagatcaccgacccgaccctgagggacgccctgcgcaaacaggtgtccgccgcgcagcagcagtaccgggcggcgtcggcggcggccgcctccgcggtccgcgcggtgcagcgcggggtcgcctccctcgggcaggcggtcagctcgctgtccgcggcacaacggctccaggcacagcaggcgtacgagttggccgacgccgccgtgcgggcactcaccctgaaagccccggtcgccggcgtggtccagttcggcgggtcggcgtcccccgccgccccggccgacctctccgccctcctgcagagcggcggcgccaccaccggcgccaccaccaccgcgggcggcgccgagggcgtggacaccgcggtcaccgagggttccccggtgaccgccggagccccgctgctcaccgtcgtcgacgtgggccggctcggcctcaccgcccaggtcgacgagacggacgtgctgctcgtcaagcccggggtgaccgccgacgtcgagctggacgcggcgaccggggccgcctacaccgcgacggtcggctcggtcgacctgctgcccaccacctcggcccgcggcggcgtctcctaccgggtgcggctcgacctgggcgacggcacctacaccgacggcagcggagcggcgccgacgccccggcccgggatgagcgcggtgatccggctccgggtgcgccaggtgcagcaggcggtgaccgtgcccgcctccgctgtggtcagcgccgacgggcacgacaccgtgtgggcggtgcgcgacgggcactaccgggcggtgccggtgcgtctgggcgtgcagggggaggacaccgtacaggtgcaatccggtctccccgccggggagcggatcgtgatctccggagcggaccgggtgcacgacggcgccgaggcaccgtgaccacgcccgccatcgtcgccacggacgtcacccggacgtacgagctggacggggtgtcggtgcccgccctgcgcggcgtctcgctcaccgtcgagcccggcgactacgtggccatcgtcggcacctccggctccggcaaatccaccctgatgcacctgctcggcggtctggaccggccgaccagcggcaccctgctgatcggcggccgcaacgtcggcgagctcaccccgaacgagctggccgaactgcgcaacaccacgatcggcttcgtcttccagtccttccacctgctggcccgcaccaccgcgcaggacaacgtcggcctgcccctggtctaccgcggggccggccgccgggaacgccgcgcccgggccgccaccatgctgcaacgggtcgggctcgcgcaccggatcacccaccggcccaaccagctctccggcggcgaacagcagcgggtggcgatcgcccgggccctggtcaccggtccgtcgctgctgctggccgacgagccgaccggcaacctcgactcggccaccgggcagtccatcctggccctgctggagtcgctgaacgccgagggcgtggcgatcgtgctggtcacccacgaccgggacgtggccgcccgggccgggcgccagatcctgatgcgggacggcctgatcgtcacggacaccgccgagtgagggtcgccgaggcctggcgggtcgccctcgacgcgctgcgcgccaaccggctgcgcagcctgctcaccatgctcggcgtcatcatcggggtggcggcggtggtcgcgctggtcgccatcggcacgggcaccaagcagcagatcgagcaccaggtggaggggctcggcagcaacctgctgatcgtcgtacccgggaaactggctgtcggatccgcgcccaccagctcaccgatgaccctcgccgacgccgacgcggtgagccgcgtcgtcggcgaccgctcccgggtcgccgtcaccatcgcgtcgggggagaccgtccgggccgggcagcggtccggcttcgccagcatgcagggcgtgctggagaccaccccgtcggtgttcgtccggcacctcgcccgcggcgcctacctgacccggaccgacgtcagcaccggccgccgggtcgccgtcctcggcgccggcgtggcccgcaccctgttcggcgaccgcgacccgatcggccggcagatgaccgtcggtggcgtccggttccgggtcatcggcgtcttcgaggagctcgggcagagcctcggtgtcgaccgggacaacgaggtgcacgtgccggtcaccgcggcgcaacgactgctgggcaccgaccggatcgacggcctggcgatccgcgcccccgaccgggacaccatcgaccggctcggcaccgacgtggtcgccgcgctcaccgaacgccacccggacaccgacttcagcgccgtcacccaggaacagatcctcggcgtgctcggcgacatcctcggcgtgctcaccggggtgctggccgcgatcgccgggatcagcctgctcgtcggcggggtcggcgtgtccaacatcatgctggtctcggtccgcgaacggaccagggagatcgggctgcgcaaggcggtcggcgcccgcccccgcgacatcggtgtccagttcctcctcgaagcggtgctgctgaccaccaccggcggggtggccggcatgctgctcggcgccgccgcggccctgctcgtcgacggcctcagcccggtccccgccgcgctcacctggtggtcgatggccctggcgttcggggtgtccgccggcgttggcatcatcttcggcgtcgtaccagcacagcgggccggtcgcctcgatccggtggtcgccctccggacggagtgacacatgcaccaacgggtacccgcaccactactggtgctggcctcgatcgcctccgtgcagttcggcagctcggtggcccgcaagctcttcggcgacctcggcgccaacgggatcacgttcctgcgcgtcggcctcgccgcactgatcatcgcggcgctcacccgcccccgggtgcgcgactggccccggcgcgcctggctcgccgccgccctgctcggcgtcgtgatggccggcatgaacctggtcttctaccaggccatccgcaccgtgccgctgggcaccgcggtcaccgtcgagttcctcggcccgctgctgctcgccctggtgcagacccgccgcctgaccgacctgctctgggcgctgctcgccgccgccggggtggtgctgctcggcctgcactccggcggcgccgcaccgctcgccgggctcggcctggcgctgctcgccggactgttctgggccggctacatcgtgctcagcgcccgggtcggcgcgctcgtcccgggcaccggcgggctggcggtctcgctcagcgtcggcgcgctgctggccgccccgttcgggctgcccggggccggcgccgtgctgtaccacccgcacctgctgatcggcgccaccggggtggcgctgctctcctcggtcatcccgtacgggctggagatcaacgcgctgcgccgcatccccacccggatcttcggcatcctgatgagcctcgaacccggcgccgcggccgtcgccggactgatcgtcctcggccagcgactcggcccgatcgaggtcctcgcgctgctgctggtcaccctcgccagcctcggtgtgaccttggccgctccgcagccggcaccggtctgaagcgctcagcttccaccgccggcgaccgatctcttccttcgtgccctatcagttgcgtgaccagcacggtgcatcccgtgccgtcgcctacctgatgatggtggccggaccgtacaacctgatcaccggcgtcctgatgaagatcggcgcgccgatcgccgaactgatctcgctcggtgtgaccgcagtcgccctcatgctggtcggcgtgctctgctggcgccggccgcaggtcctgccgaaactgttctggcccgccgtgcccctgctgtccaccgccgtggtcaccggcctgaactacgggacccgggacgcgagcaccggagcccaactgttcttcctgtggccgctgctgttcggcgcgtgcttcctcggccgccggatcaccacgctcaccgtcgtgatgatctccgccggacacgccctgatcgcgttcagctacctgccgatgagcggtgccctcaacgactggatcgcgatgaccgtcgcgatggccatgaccgcctgggtggtgaccagtctcaacgaccgcaacgaccggctccggagggtgctgcagcagcaggccaccaccgactcgctgaccggggtggcgaaccgccgggccctcgacgaggcgctgcacgaggcggtccgcgacgccgacgccggcgccgaaccggccgcgctgatcgtgatcgacgtcgaccacttcaagaagatcaacgacacccggggacacgccgccggtgaccaggcgctgcgcgccgtcgccgacgcgctgcgcgccgcgggcgacggcctggtggcccgggtcggcggcgacgaattcgcggtactgctgcggaccgggccgacagaggctttccggtacgccgagaccgcgcgcgccgcgctcaccgcggtgcccgcggcgccgacactgagcatcggggtggccgtggtgccgcaccactcggccgcgtccgccgacgaactgcaacgggtggcggacgcggcgctgtaccaggccaaggaagccggccgggggcggacggtgatcgcctcggctccggcgcggcagaacgtcgaccggattcctgaggcgcgggctacgtccgctttctgacggtcttctgttccgcggtcggctcgctgaaagcgtcggcccggatgccgtgcccgccgtggctgtctgctgtggctgggttgtggtaggtggcgctgtccgatctttcgcctgtggccgggtttccggttccgtcgcggcctctgcttgcggccggttcctcggtggtgtggcccttgtctgcggccggttcctcggcggtgtggctcttgcttgcggccggttcctcggcggtgtggctcttgcttgcggccggctcctcggcggtgtggcccttgctttcgggcggttcctcggcgttgcggccggtcagcggtgccaggatctcctctgggcgccgcggatacggtccccagccgtcccgcaggacatggatgtagaccgcctccaggcacaccccgacccgctccaccagatcggtgtcctcgtccgccccgagccggatcgcccgcgcgaaatgatcgagcgcctccatgtgccgcccctgatcgaacgcgctccgcccggcattctcgtgcaccacactgcgcaccgccggcgacacctgcgaatccaccgcccgctggaacagccgatccgcctccatccagtccccgcgcagccgcaacacatgcgccagctccgcctgcgcgatcaccatcgactgctcgtcctgagccgactccgcatgcgccagcgccagccggctcgccgccgccgccatgcccagctcgccgagcaggcggtacacctcggcgcgtacgctcagcaaccccgccttgacgatgttgtccgcctcgtcggccagcgggccgtccaggcgttccccgagctcacgcagagcattgcggtcatcgacgacctcgcggagggtgccaccgtccagccgccagcggatcgcatccaggtccgccgccgacagcggcagatgcttgccgagatcgttgggctccgccgatttcccggtacggtcgttccccgccccgccgctccggccctccgccgcgccgtcgcccggccccgccccgccgctccgaccctccgccgagccgtcgcccggcgccctagctagctagcgcgccggcccgcgtcgtttccgcgcgccgcgctgccgcccgcctgtgtgggttcgacgatcgccggggcctgggctccgccgtcctgggttccgctgtcgtgggatccgctcttctcggctccagggtcttgagttgcgtgatcttgggttgggcggtcttgaataccgtggtcttgggatccgtggtcctgggatccgtggtcctgggatccatggtcctgggatccagccgccgcatcggtcaccgcgcgcgtcgccacgccggcctcgccgccggatcgccggacggcagtgccgtcgctgccccggccgcccgcgccgtcggccgcccccgccgcatcctccttggccgccgcggtcttggtgacgaaccacccactgccgaacgccggatccgagaaccgtcgaggctcctgatcaggcccggacagctccagccgcccgatcggcttcaggttgtgccaggtcccgtccgcatccatgtacggcgccggctccccgccacccgacgccccaccgctggccggcccggacaccgcaccggccgcttccggtacaggtccggttgcgccgggcgccgcaccggccgcgccgatcgttcccggtacaggcccggttgcgccgagcgctgcgtcggtcgcgcccggcgccgcgctggaatccggtcgaggcgccgggagccaagcctttcccggcgcgggggagaccggtcgttgtccggcccgcggcccccagctgtcgtcacccgacgccaccaacggcaactcgtccgtaggcccgccactgtccgccggtgctaccagcggcaactcgcctgtcggcccgccgccatcgcgcgccgccaccagcggcagttcgccggtgacccgctcctgtcctgggatggcctgtcctgtgatggcctgtgctgggatggcctgtcctgggacggcctgtcctgggacggcctgtgctgggacggcctgtcctaggcctggctgcgcctgcattgcctgtcctggtgaagagaccggccacggcgcttcgggcatcgggcgctggtgcggcacgccctgccggaccgccccatgcggcagcggtccaccgtgctggttcgcctcccagtgcccggcaccggagaccggccaggcctcccgagtgtggcccggcccctccggactgtgggctgctcgttcgaagccacgacccacctggtccgtgccgtgcgggtcggcgttccactgtgcggcagggaaagccggctggccgccggccgcatgggcggcctcctggtagacaccctcccggtgcgcgcccgaggagaccgggtgcgcggcggcgggattctgcggctgagccggaccctgcacgaccgcttgatccggcacccagccgggcgccgatggcgactgcggatggacaccttgctgcggcaaagttccaggcgggaacgtcaggcgccccgactcgaacggcgcaggaccggcggttccgctgttcggcagagcaccggggactccgggaccgcccggcgcaccaccggacaccggtggcaccgcaccctggtcggacttgggcacaaagccgttgggcagcgccaccggcctgccgtgcggagcggccggactgcccggcgccaccccgtgccgcccgtgcggtgtctccgaacccatgggtccggcgtgctgcccgtgcggtgtctccgaacccatgggtccggcgtgctgtccgtgcggggtcaccgggccgccgggaccggcgtgctgcccgtgcggtgtctccgaacccatgggtccggcgtgctgcccgtgcggggtcaccgggccgcccggaccggcgtgccagccctgcggagcggccgccgttccctctgagccggcatacggcggcactactccgggcgcagccatcggaggcggcgaggctgggccgccggtgctgcccgtgtactgcgacgggaccagtcccggaggcggcgcaaccggctgatccggctgcggtccagccatccgtgggtgcgacgtggtcggctgccccggctgggcgccgagcagacgcaaaggcggcgcgaccgggcgctcgaagtgcggcgtaccggccggatcgcccggtgctcccgggccgttcattgacgccggcatgccgggttgtcccggctgaaccaccatcgggccaccgggcgacgaggcgggctgcggcccgccgaagccgggcagtggtgcgacgacctggccgggatactggccggggtgcgcgtcggagtagccgtgcggtggtgcggtcggccggcccggctgcgcgccgatgaagccgggcggtgcgccggcgatctggccgggagacggcacagtcggctgacccggatgtgaacctgcgggcacaccgggctggtggccgaccggtacaccgggctgctggtcgactggcacacccggctgctggttgaggggtacaccgggctggtggcggaccggtacacccggctgctggttgagcggcacaccgggctgctgactgatgggcagcggcgaagtggcggcctggccgggtgacggcgggacgagggcgggggagccgagcggctggcccgcattcgaaagcgtcggtccggcaggggagatcgggccggcaccgctggtcgggaccagcgggccggtgggtgggaccgggaccgacggtgaaaccggtgggatcggacccgagccggtggacggcaggggcccggtaggtgacaccggcggctcgccggtgcccggcatcggcatcgtggggcggttcaccggaaccgggccgcgggccggtgccaccgggcgtccggcggcgtgcgtcggtgtcggcatcggcggagcctcgtcgggcacgatggcccaggggccgtcgccctcggcgaggaagacgtgtgcggttcgcggggtccttccggtgcgctgctgaggcacgttcgacgccggatacccggtgggggccgggagcgtgggccgtccgacagcgtcctgagccgggccgcccactagctagctagcgccggtccgctgacctgccgggggtcggaaacctgtgccggtccgccgaactgccgggagtcgggatcctgagccggtccgccgggctgcggtgctccacttaccgctcgcgggtcgggaagctgagtcgggccgccgacctgccgcaggtcggcgggcgaggccgggccggccccctggcgggaaccggtgatctgcccgggttcggctgtctgccgcgggtcggtgagatgaccggggccgttgagccgctgagaatcgacgaactggccggggccaccggtctggccgggcgcaccgggctggtgggggatggcaccgggcgtctgctgggggccggggaacggcgggtgggggttcgcgaagcgcgggtcggccggcattgcgctgggtgtggtgttcgacggtgccgagccggcggggtggtccatggcggagagcggtgccgggtggtggccggcacggtccgcggcggtggggctgacgggtgtggccgggccggggcggggggctgccggcgtaccggaatcgacggagaccgggaccggggactccggtgacgaagggggcatcgcgggcgaagccgacggagtcggcgagccggaggcggcgggtgcgaccgggacctgcgggccgttcggaccgatgatccgggccggcggggtcggctgcggagcggcgacgacgcggggggcgaccggcggctcgctcttgagaacccgtggcgccgggggaggggtggcccggctgaccaccttgggcggagccggcggctcggcccggcggaccacccgcggcttgccgtccccggtggccgcagggtcctgcgccggcggctcgaccggggtctcgtagtactcgccgtccagcaccgtcggcacgctgacgcccatggggcggtcgtcgtcctcgccggtccggtcgtcccggccgatggcacggtcgtcccgctggccggaccgctcgtccgcggtccaggcgggcacgccctggccggcccggcccgggtcggcagcgccttcccactgctcgtgctcgccgttccattgccgcggctcgccgtcccactgctggggctcgccgtcccactgttggggctcgccgtcccactggtcggagtcgttgttccactggtcggcggcgccgtcccaatggccggggctaccgttccactccggggcggcggcggacctttcggtgtcggcggtgggccactcggcgttggtgttgttccagcccgtggttgcccgcggggcgttccagtcctgggcgtgcaggtcgatcggctcgtcgtcccgggctggcgagccggcccggccggagacccggggaccgtccgaacgccgctcgatgccggaagcatcggcatccagcggcacgcccctgcggtcggcaccggaaacgtccagcggccggttctcgtggtcgccgccgaaagcgtccagcggccggttccggcggtcggcaccggaggcgtccagcggccgaatctcgccgtcggcgccgggaacgtcggcgtccaccggccgcttcctgcggtcgatgccggaaatatcagcgtccagcggggcgcgcctgcgatcgtcgagccgttcctcgccgccgggtacctgagcccgtccggtgacggcgcccgtccgatcgtcacggcgggccgggccgcgccgcgggtcctcgtcgtcgcggtggggtcggcggccgccgaccggccggatcggcccgaaatcctcgtcctcccagggctgcgagaccgtaccgcgtccgcggtcgccgggtcgcggaaccggtccgctgccgcgccgttcgcccacccgcccgcggccgtccgcgtcgatctcggcatcgcggcgccgcggttccggcccgtcccaccgctcgtcctcgcgccgcccacgccggggttcgtcctcgcgccgtccgcgccggtcgtcatcccggcgctccaccggccgcgacccacgcgcgtcgtcccaccgcccgggggacgcggcgtcccgcccggacagcgcgtcctcgcgccgccccggcagtgcatcgtcccgccgccccggcagtgcatcgtcccgccgcccgggcaacgagttttcccgtcgccccggcagcgcatcgtcccgccgcccggccgatgattcatcgcggcgcccggaggccgcaccatcccgccgcggtgaaagcccggcatcccgccggaccggagcaccgtcctcccgccgccccgaaggcgcgccataccgatcacccggccgccccgcctgccgctgccgccgctccggattctgcagagcagccggatccacgatcggaaagtccggtttgtcgaagtcgatccccagctcgggccggttgaagtcgatgtcgtcgaagtagtccccggacaggttgtcgaccgaggtgtcgatcggcacgaagtccggatcgtcgagccagctgggccgctggtcgtcgaacggcgcccggggtcgacgagcccccgagtcgtcactgtccgtgttcgagcggcgggtggggatgaccgggtcgggggcggtccgcttctcgaagtggcgttcctgggctaccgcgtacttcggcatgaaggagtattcgttgtactcctcgtcccagtattcgtcgtcctcgaagctcatgacgcggccccgttacggctggggaatgtcccaccgccccgtcgccgcatctgtgccaccgtcctcaccttggaccacctccgcgcccccggtgcccgcccctcgcgccccggatgaaaccgccccacgtggtggatggggaaggttaatcacggatttgcctggtgcgccaccgcctgcggagcccccttaccgggcccgcgaagccggcggggccggtgaccgccccggcgccgcagcccgccgggtgtgttcggtcgctggagaatacgtccgccgtacgctccgggttcaatgaggtgagcagtcactatgccgggtttccggggagggtgccgcgacgccgggtgatccggcggccgcgatccggagcgccgctcggcttaaggatttcttaagattcatttcaggagacctaggaacttgcgggtgaccctgatcaggtgacggaacgtggcgaaggacaccccgcctgaacgcggatcatgagggctccgcctggcacggttgtggtgcggcccggtccacaaagcacggcccgccgcaatgccggagcagcagaggccggtgcaaggcgcaggaaagtgagaagctccccggccgagcggccgtcgccccccagttctggcggccgctgactcgcgcccatggacgacccgcccgggagaccgccccccgaccttccgggcgcttggcggatcagggcgcaccaggccgggacgaggggcggcggcgggagcgatcccgccgccgttcccgatgtgcggctcggatccgcccgtcggtgctgaagggtttcgaccttccgccggcgtacagcacggccgcggtcacgggccgcaggacgcgctggaatacgcatggttcgaggtcggcacgtccaccaccccgccgccccagaactgctcactcaccgtatatccgctggcgaccagtgcttgcgccgcggcgcgcccgctcgggccgtcctcccaggtcaccatcggcgggatcgcgctgtccacggtcggacgcaggcccggcaccgcaccgagcgtcgccacgagtcgcagcgtcccgggcgtcggcatcacgcgctgatcatgacgttcggtgacgtcggttcctagtggcaggcttcgattcacagaatgttcccgacatttcgcccggggacgagaggcggcttcccgcggacggccaggcgacggaacggcgaacatcagcgatgtaaaccacagttcggctcacggtcatgaatcggtcgggacccggccccggcccgaccttcccctgggtggcatgcgcatcgcgctggtcacagagtccttcatgcccgacgtcaacggcgtcgcccactcggtcgtccggaccgcggagcacctgatccgtaccggtcacgaaccgatcgtcatcgcgccggtgccggcgcccggaccggtcccggccaccctgccgtacccggtggtccggatcccgtcagtgccgatgccgggctatccgcagatccggctgggtctgccgatgccggccctgcgggcggcgatccgggatcatcgcgccgaggtggtgcacctggcgagcccgttcgtgctgggcgcctgggcgcgtaccgccgcgtcgagcctcggcctgcccacggtggcggtctaccagaccgatgtggcggcctacgcccgcgcccgcaacctcggcgtctgcgaggatctgtcgtggcgctggatccgccggctgcacaacgccgccacccgcaccctggcgccgtccaccgagtcgatgacggcgctgcgcacgcacggtgtcgagcgcgtgcacctgtggcgccggggtgtcgacgacgtccggttccatccgggtcggcgcagcgccggtgtccgacgcgcgctgtgccgcgacggcgaagtgctggtcggtttcgtcggccggctcgccgtcgagaaagaggtcgacctgctggccggcgtctcccgcctgccgcatgtccggctggtggtgatcggcgacggcccggccgaggcgcacctgcgccgggcgctgccggaggccaccttcctcggcgcccggcacggcggccagctcgcccggatctacgccagtctcgacgtgttcgcccacaccggcccgttcgagacgttcggccagaccgtccaggaggcgatggccagcggcatcccggtggtcgcgccggccaagggcggcccccgcgacctggtccaccacgaccacaccggtctcctggtccccgcgcacgaggagacgggtttcaccgatgccgtcgcccggctcgccgccgacccgtcgctgcgccgcgcgatgggcgccgcgggccgtgccgcgatcgccggccgcagctggtccgcggtcggtgaccagctgctccaccactacgccgaggttctcggcaggccgctcgcccgtcaggaggttgcccgcccccgggccgctgccgcttgaggaggctagctagctagcaccccgccgcgcaccccgggaaatcgcgccccgacacgcccgggcgccgccgctgcgcgaaacggaccccgcgagcaccgccgccacctgagatctgcagtacaccggcttgcccgggacgctccgccggtctttgatttacgtcccggaaaccgcgtcccgggcgggccgggtggccgggcacagcggtcagggagcacgattgccctcggcgcgcatcgccgcgccgtgaccaccatcacggcgtcaccaccgaccgggaccggagccgctgactagggcatgaggccagcatgaacaatgaccgaaccggagtccggcatcgccttctggacgcctgccgttcgtccaggctcggcctgctggtcgcccgtcgccgggaccacctgccggtgctgacgacgcgggctctgcgctgggccggtttcggtggtgccctgctgctcgcgctggccggcctgttcggcggggcgctgccggacgagggcggccacaacctgccggtcaccacgctgtggctggccggcacggcgctgctggggtacgcgtggtggtccggccgggatcgcgagctgagcccccgctgggtgctcggcaccgccgcgctgtgggcggtcccgttcctgctggtgccgccggtcggcagccgcgacctctattcgtacagctgtcagggtgagctcttcgcgcacggcctgagcccgtacacgtcgaccgcgcagaccctgccctgctcgtgggtgggtgcggtgccgccgatctggcgggacacgatcaccccgtacggtccgctgttcgtcctgctggccggtgcgatcatcctgctcggccaggcggttgcgctcccgtccggcctggtcgacgcgctgccgccgcacctgggttcgctgatcctgccgctggtcctgttccggctggtcgcgctgggcggcgtggtggccatggcggccgggctgccggtgctggcccgccgctgcgggatcgcgccggcccgcgccctgtggctgtcgctggccggtccgctgatcggcctgcacctgctgggcggcccgcacaacgacgccgcgatgctcggcctgctggtcggcggcctggccgtggtcacccggtgcccgcggcactgggcggcccgggtcggcggcggggtgctgctgggcgccgcggtcgcggtgaaggccacggccggcgtggccatcccgttcgccgtgctgatcgtcgccgccacctaccggagccggctccagggcctggtgatcggcacgctcgcggtcgccggctcgtcggtggccgcgctggccggcatcaccgtggccggcgggctcgacctcggctggatcgccggcctgtcggacagcggcgccctggtccagttcagttcgatgcccaccgcggtcggcatgaccatcacgtacgccggccggctcttcgatccggatttcgacgccgtgccggcggtccgcgcggccgcctacgccgtgctcgcggtcgccctggtggtcatctgggtccgggcgttgcgggaccgcgccgacccggtgcgggcggcgctgttcggctcggccgccgcgatcgtcgccacggtcgccctggccccggtcttcctgccctggtacatgttgtggccgctgaccctgctggcggccaccacgctgcgcaccaaggcggtcatggtgatcaccatcgtggcgtcgttctcggtgctgccggacggctccgggctggtccggtcgctgaagttcccgggcgccccgatggtgaccctctacctgatctacctcggtgtccgccaggtgcgccggtggcgcggtgggcgcgagcttcaggcgctggtcgcggccgacggcatcagcgaggccgagccgagcacccgggcgacggcgacctcgatgaccacccgggccgggttggggcgcggcgtccggtaacgaccggcgtaccgccgctccgcctcggcgaccgcggccggctcgtcgcggatcaccgcgaggccctccagggtgctccagcgtggcccgtcgacctggcagatcgccacccgctgctggccgcgcagcacgtgccgcaccttggccgagccgccggaggagatgatccgggcgatcccggtttccgggtcgagggtggcgccgaccgccaccacgtgcggcgacccgtcggcgcgcagcgtggtgagcgtgcacagatgccgctcggtccagaactcccgcagggccgtcgactccaggctgatcacgccgctcatgccacctccgctgccagctcgccgcgacggaccgccgcgacgagcgcctgatgatccttctccacctggtcggcgtacgaccgggcgaacttggccaatgactcgtccagcttgtcgctgccgccgcagtatccggcgatcatcgacgccccgctggtccgggcgtgcgacttggccagcaggtagccgcagatcccggcgtagtcggcgagcgcaccggcgttgatgtcctcgacgacgatggcgcccttcatgtcgcggaactgccgcacgtagtactggtgctcacccacggtggtccagcccagcagcgggtcgctgaccgtctgcagcgcctgctggtattcgaccacccgctgcccctggtgccggtgccaggccagcgcgccgtgctggtgtttcgcgatcaccgaccggcgggcctgcttgagctggaggaagaccacgtcctccgggtcgctgccctcgcagagcgccacgtacgcccgcaggccgaccgagccgacgccgaccaccttgtgcgccacgtcgatgacccggtagccgccgaggatccgcgcccagtgcggtttgagcgtgttcagatagccgtccagggcctcgtcgagcaggtcccggtcggcgtccgacggccgggtgatcaccggcggctcctcgaccagccggcggctgccgtcgcgccgctcggtgaaccggggcagcgcccggtcgctggtgcgccgccgggcccggcgggcggcccgctcgatctcgtcgcggaagctgccgcgggtcgccaccgaccgcatcgcgtcgacgttgagccggtcgaaggagcgggccagcagtggccgggcggccagatcggcgatctgcccgcggtactcctcgacgcagtgctgcaccgcctcggcgcaggcgctctcccggaagccgttgacccggccggccacgtggacgctgaccaccaggcggcgcaggtcccactcccaggggccggggtgcgcctcgtcgaagtcgttgaggtcgaagaccaggtcccgctccggggaggcgtagaagccgaagttgccgaggtgggcgtcgccgcagatgaccggggtgatgccggtgtgcggcaggccggcgaagtcgtcggccatcagcccggcggtgccgcgcaggaacgcgtagggactggcgatcatccggccgatccggaccggcacgagccacggcaaccggccctcgtgcgaggcccgcacctgacccaccgggtcgggccggtcggccggcggacgccactgcgccacgtccgaccggggggaccgctcgcgcagagcccggcccatctcgtatcgttcggcgcgcggccgtgcgggacggcgcagggaggtgaagccctcgtcgcccgctgagccgggcaccacagggctgccgatggtgggtgtcgcgtccattgctgccgagagtacgggtcggtgagcaagggtcgcggaggggctcgcggcaccggcattgttatcgataacatttcccacaccgggagacgcggcgcgccgctacgctccatcagatcggtacctggcgaggagcgcaagtggagaccaagggatcacgttccccggcgatgaccgacgtggcacgtctggcgggcgtctcccaccagaccgtctcccgcgtgctcaacgatcatcccaacgtcaaggagcagacccgcctgcgggtccgggccgcgatcgccgagctcggctaccgccccaaccgggcggcccgcgccctggtcaccggccggtcccagctgatcggcgtggtggcccgcaacagcatgctctacggcccggcctcgatgctcaccgagttcgagcaggcggccgccgacgccggcttcgcggtcagcgtcggcagcgtgcgtgagctggaccgggactcgatcgccgcggtcgtcgaccggcacctggaccagcgggtcgccggcctggtggtgatcgcccaggtcgcctcggccaccgaggccctcgccgagatcccggccgacgtaccggtggtctgcatcgacggcgacccggcggccgggcgctcgctggtcaccgtcgaccaggtggccggcgcccgggcggcggtccggcacctgctggaggccggccacgagaccgtctggcacgtctccgggccgaccgactggttcgactcggccgggcgcatccagggctggcggcagaccctgcaggaggccggccgggaggttccgccgctgctcagcgccgactggtcggccgccgagggctaccgggccgggcagatgctggcccggatgccggaggtcaccgcgatcttcacggccaacgaccacctggccctgggcgtgctgcgggcactgcacgagcggggccgccgggtgccgcacgacgtcagcctgatcggcttcgacgacgtgcccgaagcggcctatttcatccccccgctgaccaccgtgcgccagtcgttcggggacgtggcccgggccgctctgacacttctgctgggacagctcagggacgccccgcggcccgccgatacggtgatcgtcccggcacggttggtagtgcgcgagagtgtcgccccgcccgcgtaagtctcgatttcgcggccgttactttgttgttgcgaagagccgttgacacgacttttgttagcgataacactgatcgcacatcacgagatggccgccaagatccttgacgggctcatcatcgcgtctccggtgctgcacgatgaaatgcgtgggatgtccgcatcccgcccggcgtgacccgcccttccggcggagaccgccggcccggcacgacccgcctcccgcggcgggaaccgccggcccggcacgactcgtccccacggcgaggaccgccggcacgcgcagccaagcgccacggaggcccggtgactgcaccacgacaccaaaggaaacggatgaagccgcagatctggtttctgaccggcagccagcacctgtacgggccggagacgctccagcaggtggccgaccagtccgctgagatccagcgcaccctggccgccggcctgagcgccgagctcgtcacccgcccggtgctgaccgactcgggcgcgatcaagcaggtgatgctcgacgcgaacaacgacgcgaccgtgatcggcgtgatcgcctggatgcacacgttctcgccggccaagatgtggatctcgggtctggacgcgctgcgcaagccgctgctgcacctgcacacccagcacaacatctcgctgccctgggagtccatcgacatggacttcatgaacctgaaccaggccgcgcacggcgaccgcgagttcgggttcatccaggcgcgcctgggggtgccgcgcaagacggtggccggccacgtctccgacccgtccgtggtgtcccggatcgacggctgggcccgcgccgctgccggcctgcagcgcctgcgcaccctgcggctggcccgcttcggggacaacatgcgcgacgtcgcggtcaccgagggcgacaaggtcgaggccgagctgcgcttcggcgtctcggtcaacacctacggcgtgaacgatctggtcaccgtcgtcgacgcggtggacgacaaggcggtcgacgacctggtcgccgagtatgccgaccggtacgagctggcccccgagctggccgtcggcggggcgcggcacgactcgctgcgctacggcgcccggctcgaggccggcctgcggcagttcctcaccgagggcggcttcggcgcgttcaccaccaacttcgaggacctgggcggcctgcggcagctgcccggcctggcggtgcagcgcctgatggccgacggctacggtttcggcggcgagggcgactggaagacctccgccctgctggccgccgtgaaggcgatgggcaccggcaccggccggggcacctccttcatggaggactacacctaccacttcggtccgggcgagccgaagatcctcggggcgcacatgctcgaggtctgcccgaccatcgcgtccgcccggccgcgtgtcgagattcatccgctgggcatcggcggccgggaggacccggtccgcatggtgttcgacgccacgcccggcccgggtgtggtggtcggcctggccgacctcggtgaccggttccgcctggtggcgaacgcggtcgaggtggtcgagccggacgagccgctgccgaacctgccggtggcccgtgcggtgtggaagcccgccccgtcgctgtcgacctcggcggagtgctggctcaccgctggaggaccgcaccacacggtcctcacccaggctgtcggcgcggaggtcctgcgggacttcgcgacgatggcccagaccgagctcctgctcatcgatgaccgcacctcgaccgacgacttcgccgaccgggtgcggtggaaccaggcgtaccaccgtctggcccgccccctgtaacaccgctctcaaagaggagattcaccgtgaaatacacccggctcctggcggcgctcggcgctgccacgctggtcaccaccatggcggcctgcggctccagcgagaagaccgcggacaaggccgccggcagtgggaacaccgcgggcgcgctgatcggcatcaccatgccgaccaagtcctcggagcgctggatccacgatggcgacaacctcaagcagcagctcgagggtctgggttacaaggtcgacctgcagtacgcggagaacgacatcccgacccagacgcagcagctggacagccagatcaccaagggcgccaagctgctgatcatcgcgtcgatcgacggcaccgcgatctccaaccagctggacaacgcgaagaacgccggcatcaaggtcatcgcgtacgaccgcctgatccggggcaacgcgaacgtggactactacaccaccttcgacaacttcaaggtcggtgtgcagcaggccacctcgctgctgaccggtctcggcgtgctcaaggccgacggcagcaagggtgacgccaagggcccgttcaacgtcgagctgttcgccggttccccggacgacaacaacgcgacgttcttcttcaacggcgccaagagcatcctggacccgttcatcaaggacggcacgatcgtcgtgaagtcgggccagaccgacttcaagaccgtcgccaccctgcgctgggacccggagaccgcgcagaagcgcatggagaacatcctcacctccacctacaagagcggcgccaaggtcgacggcgtgctgtccccgtacgacggcatctcgatcggtatcctgtcggccctgaagtcgggtggctacggcaccgccgcgcagaagttcccgatcgtcaccggccaggacgccgaggtcgcgtcggtcaagtcgatcatcaagggtgagcagtactccaccatctacaaggacacccgtcagctggccaaggtcaccggtgagatggccgacgccatcctcaagggccagaccccgcagaccaacaacaccacggactacgacaacggcaagaaggtcgtcccggcccagctgctgcagtcggtcatcgtcgacaaggacaactaccagaaggtgctcgtcgacggcggttactacaccgccgaccagctgaagtgatccggattccgcgccccgcccgccacccgcgggcggggcgcggacttcatcggcccttaggagggtctctatgaccgacacgatcctgcggatgaccgggatcaccaagacgttccccggcgtcaaggcgctccaggacgtcgacatcgaggtgcgcaggggcgagatccacgccatctgcggggagaacggggccggcaagtccaccctgatgaaggtgctgtccggggtctacccgcacggcacctacgagggtgacatcgagttcgagggtgagccgtgccatttcggcggcatccgcgacagtgagcaccggggcatcgtcatcatccaccaggagctggcgctcgcctcgaacctctcgatcgccgagaacatcttcctcggcaacgagcgcagcaagcgcggctggatcaactggaacgagacgaacgcggcggcggacgatctgctgcgccgtgtcggcctcaaggagaaggctgtcacgccggtggtcgagctcggcgtcggcaagcagcagctcgtggagatcgccaaggcgctctccaaggacgtgaagctgctcatcctcgacgagccgaccgccgcgctcaacgacgacgactcggcgcatctgctcaacctgctccgaggcctgcgtgacgagggcatcacctgcgtcatcatctcgcacaagctcaacgaggtgatgggaatctccgatcgcgtcaccattctgcgtgacggccggaccatctggaccgacgagatcgagaacctcaccgaggacaagatcatctccggcatggtgggccgcgacctcgagcaccggtacccggagcacgaaccgaccgtcggcgaggaggtgctgcggatcgaggactggacggtctacagccccacccagccggaccgcgcgctggtccgcaaggccaacctgacgctgcgccgcggcgagatcgtcggcctggccgggctgatgggcgccggccgcaccgagctggcgatgagcgtcttcggccgctcgtacggggtgaacatctccggccggctgatcaaggacggcaaggagatcaaggcgcggaccgtgcgcgaggcgatcgaccacggcatcgcgtacgccaccgaggaccgcaagcggtacggcctgaacctgatcgaggacatcaagcgcaacgtgtccgcggccggtctgtccaagctggccaagggcggctgggtggacggcaacgaggagttcaaggtcgccgacgagtaccgggcgagcatgaacatcaagtcgccgaccgtcgaggcggtggtcggcaagctgtccggcggcaaccagcagaaggtcgtactgtccaagtggatcttcacggatccggacgtgctgatcctcgacgagcccacccgcggtatcgacgtcggcgccaagtacgagatctacacgatcatcaaccggctcgccgacgaggggaaggccatcctggtcatctcctccgagctgcccgagctgctcgggatctgtgaccgcatctacaccctctcggccggccggatcaccggtgaggtgccgcgcgccgaggccacccaggagagtctgatgactctgatgacgaaggaagaacaggaggtggcgccgtgaccgtcgcacctaccaacgctgacctgtcgatcagcgagggaccggccggtgccgggaacgcggcccagcggaaggtcaacttcgacctgaagtcgagcggcatctacatcgcgctcgcgctgctcgtcctgggcttcaccatctggaccggcggcgacctgctggcgccgcagaacctcagcaacatcatcgtccagtactcgtacatcctggtgctggcgatcggcatggtgctgatcatcatcgccggccacatcgacctgtcggtcggctcggtcgtcgccgcgaccggtgcgttctccgcggtcatgatggtcaactggggcctgccctggccggtcgcggtgatcgcgacgctggtcatcggcgccctgatcggcgcctggcagggctactgggtggcgtacttcggcatccccgccttcatcgtcacgctggccggcatgctgctgttccgtgcggtcacctacatgatcctgggcaacaagggcatcggcccgttcccggacgagatccgcaccctggccaacggcttcatccccggtttcctgggcaacgtcgggctcggcagcctcggcggcgccgacctgttcagcctggtcgtcggcatcctcgtcgtggtcgccatggtcttcgtgcagtggcgcgcccggatgggccgggtccgctaccggcaggccgtcgacccgatgtggctgttcgtggccaaggtcgccgtccccgcggccctggtcatcttcctggtcgtgcagctcgcccggttccgcaacctgccctgggtgctggtcctgctcgcgatcctggtctgcgcgtacacgctggtcaccaaccgggcggtgttcggccgccagatctacgcggtcggcggcaacctgcaggccgcgacgctgtccggtgtcaaggtcaagtcggtcgtcttctggctgttcgtcaacatgggcgtgctgtccgcggtcgccggcatcatcttcgccggccgcctcaacctggccggcccgaccgccggtaacagcttcgagctggacgccatcgccgcggccttcatcggcggcgcggccgtccagggcggcgtcggcaaggtggtcggcgcgatcaccggtggcctgatcatgggcgtgatcaacaacggcatgggcctgctcggccgcgcgccggaggaggtcatgctgttcaagggcttcgtgctgctgctggccgtcgccttcgacgtctggagcaagcgccgcaccgccaccgccaagtaggcaggggcgccgcgaggcagtgggccgtcacggtgacgtggcggcccactgtcgtcatcgggccacggcacaaccgaaactgctcggccgtacgccggggaacaccccgtccagcgacccgaaaccgcagcgcctctgcagcacctccccgatcaccgaccggtagtcggtggtggccgccaggtcgcccgccaccagcgcgccgggggtcagcccgggccagtccgcgtacaccttcccgccccggatcccgccgccgagcagcagcatcgcgttgccgtggccgtggtccgcgccgtgcgaggcgttctcctgcacccgccggccgaactcactgatcgtcagcaccgtgacggagccgagcgccgggcccagatcggtggtgaacgcggccagcgcggccgccaggtcggcgaggttgtcgtacatccgctggcccttgaccgcggtgccgagcccgttgtgcatgtcccagtcgccgcagtcgaccgccgcggtgaccaggccggccttcgccttgatcagccgggccacgtcccgcagcgccgcaccgagctcactgtccggatacgtggctgccgccgcgtacgccgcatcgcggaccgtgtggaccgcggccagcgcgcggtcggcggaccgggccggaccggccagcgccgccggcgcgtcggcgtacatcgcccgcagcgccgcggccatcggccgcttcccctcgccggccaggctgaagccgtccagtccggtcatcgccacgtcgtcggccgcgccgagcaggatccgggccggcatcgcgtgccccagcgacaccccggccagcggggcggtcgcaccggtcagcccgagcatccggtccagccagccgctgcgcagcgaggtgccgggcgcggcgttctccatcgcctccatcgcggcgaaatgcgaccgggtggggttcggctgaccgaccgcgtgcaccgccgccatccggccgccctgccagagcggcagcagcggggcgagcgccgggtgcaggccgaaggtgccgtcgccggcgatcacctgactcttcggcacaccgatcccgggccgggccgtgtagtaggcgctgtcgccgattgggacgatcgccgagagcccgtcgaaaccgccgcgcagtgagatcaccacgagcgtgtcgccggagtacgcgcccgcggcgaacgccacccgggtgctcagcgcggccccggccacaccggccagggtggcgcccaggatgctgcggcgggaaacggtgccgttcatgatcacctcagcgggaaggacggcgcgtcgaggacgagcgcgatcaggtacggggtgtgcccggccaaggaccggtccaggacagtgttcggcagcttcccggcggcactgagcacggcggcggtgtgcgccgggggcagaacggtgccgatcagccgggtggcgagcgcgtcgatcagcgcgccgtaggtcgccggcagcaccggaaccagcgccctgagcaggtcggccggccggctcagctgcttcggataccagccggcggccaggttgaggtgccagttgcagcgcagcaggaacgccgacggcgacgcccaggccgccgcgacgtccggatacccgttcggcggcgcccagcggaacggcgcctggcccgcggtcaccgcgatgtcgtagagcgcgtccagccccttcaccccgtccgcgtccgggcccaggcccagcacccgcacggtggcgatcagatcctcgaacggggtgcggaccttctgcccggccgcggccgcgaactccggcgcggtgaacagggcgcgcagcaccggcacgatcgcggtgccgttgtcgagatagaccttggccagccgggtgaccagcgcggccggcggctcgtcggcgacgaaccggacacacagcttgcgggccaggttccgggcggtcgccggatgcatggccaggtggtcgaagaacgccagcgcggccggctccccgttgacgcccgcgttcgcgtggcggaagccgaggatgtccacgccgcccacggcgtgccgggtggtgtcgtacacgtaatccccggtcctgcccaccgtcatgccggtgagcaggcgggcggcgtcctgaacgtcgccctcgtcgtaggccatcccgaccgtgtgcaactccatcagctcacgggcgtagttctcgttggggtgcgaccgggtcgacgagcgctgatcgagataggtcagcatcgccgggtgccgggcactggcccggagcatgtcggcgaaccggccgaaggcgtgcttgcggatcacctgggcgtcgtagtcggcgcgggtgtcccacaccccggcggacggcgcggcgacgtgcaggtggttggcccagaaggcggccaccgtctcgaacagctgccgctcgctccacgcggcccgggcgatcgcggcccggcccagctggcggaaaccctcgtaggagtccttcggcagcgcggcacgcacctgcgccggggtggcgccggccagcggcagccgggccagcaccgcgtcgcagcggctgtcgtcgatgcgctgcgggtcgagctgacggtccagccagccggcggcgcccagtcggcgtgcctcggcgagagagtccggggtggcaccgaaggtggtccggcgcagcaggtgggcaaccaggtcgtcggccgtcgtcatgcccgatgcttcggcggctgcgcgccggcgccgcacgacggcaaccgtgactcaccggtccgcaatccgggcgcacccgtgaccggacaacggtgacggacgtaggcttcgtcccgtggatcaggctgaaacggtacgcaccccgtcgtcctgggtggtcgtcggactcgacaacggcggcacctgcaacaacgccaccgtcctcgacgcgacgggccagttcctggtgaacaatctcgtggagaacccgtcccgggtcctcgacggccccgagtcggcggtcgagtcgctcgccgaggcgttcaccaacatcctggagctgaccagcaccccgctgtccctggtccgcgcggtcgggctggacacgcccggcccggccagcgcgcacggagtgatctcctccaagggcgccaccaacttcaaccaggtgtcgtggcacggcttcgacatccgcggcgccctggagacccggctcggcctgccggtgatctacaacaacgacgcgaacgccgccgccctctacgcccaccaccgccacttcggcacggccgccctggagacgtcgtcggtggccgcgatcgtcggcaccggcctcggcggcggcgtcgtcgaaaacggcaaggtgatccgcggcgcggccggaatggccggcgagctcggtcacgtccagattcccctgcacggcgtcctcgacgacggccagccggtccccaggtgcaactgcggcttcgagggcgacgtcgagtcgatcgcctccctcaccggcatccgcaacaacctgctgccgtactggctgacccgcttcccgggacaccccctcgccgccgagccgatcggatcagcggccaagatgctccgcggctacggcgagaaggacgacccgctggcgatcgccgtcttcagccagcaggcccgggcgatcggcaaactcttcaccatcgccgccaacttcaccgacccgtcggcctacttcctgggtgggggagtggtcgaggccgccccgcactttcgccaatggttcctgaacaccgtccgcgaaagcacccagctccgcgacgaacaggccagagccgccaccttcgccctggtcgccgacctggacatggccggcgcccgaggcgccgcggtcgccgccctcgacgcggtctccaccggcacccgctgaccgcgtcggcacccgtcccgccggctcgggccggcgtccgccaccgatgccgcgaacgcaccgggccggacgccccggtcagcatcggcccgcgccgcgaagccgtccaacggatcacccgttcaacggtgcctgacggggcgccggcaggacatctctccggtcggtgcgaatccgccggctcatgacgtcgatccggtccgcgcaggtggtcagcgcggcgcggggcgcatcgcgtacgccaggagcggtctattcgtctttcagggccgctgccacatccgggaacatcggcagatagtcggacaggccgagggtgtcgaagaggcgccggaggaagccggacggggcggccagccgcacccagccgccgcgctccatggcgcggccgtgggcggtgaccaggacgccgacccccatcgagtcgcagaagtcgaggccggagacgtcgaccacgacccggggtgcggggcgttcgaccaggcggccgaggttggccttcagcgcgggcgcggtgtcgatgtcgagcgaaccgcgcaggacgaggacggccgtgttcggtgggtggtgcgcgaccgatacctgcatgtgctgtttctttcgatcggggggcgggctgcatccaaccctatgcgagcccgcccaccgtcgcagttctcagatcgagttgcgccatttccgaccgttacgcccgatcagccggtccgcgtcggccggtccccaggaggccgcctcgtaggtcgggatcggcgagcggtcgttcgcccagtgctcgatgatcgggtcgacgacccgccacgactgctccacctcgtcactgcggatgaacagcgacgcgtccccgaccagcgcgtccagcagtagacgctcgtacgcctccggcgactcttccacgaaggtctggtcgtacgagaagtccatgctggcggtgcggacccggaacgagtggccgggcaccttggcgccgaagcgcagcgagatgccctcgttgggctggatgcgcagcaccagggcgtccgcgtccagttcggtgagctggctggtcgggatcggcaggtgcggtggccgctggaactgcagggccacctcggtgacccgggccgggagacgcttgccggtgcggacgtagaacggcacccccgcccagcgccagttgtcgacgttgagacgcagcgccgcatacgtctcggtgcgtgacagcgggtcgacgccgatctcctcgcggtagccggccatcagctcctcgcgggtgccgccgcgcgtgtactgcccgcggaccgcggcgtcggcgatgtcccggtcggtgggcagccggatcgcctgcagcagtttcaccttctcgctgcgcaggccctcgccgccgaacgaggcgggcggctccatcagggcgagcgcgagcacctggagcacgtggttctgcacgatgtcgcgcatcgcgccggccgactcgtagaatccgccgcgggtgccgacgcccagcgtctcggccaccgtgatctgcacgtggtcgacccacgaccggtcccagatcggctgaaagatcgagttggcgaagcgcagcgccagcacgttctggacggtgtccttgcccaggtagtggtcgatgcggaacacgctggactcgtcgaacgcggcatgcacgacgccgtcgagctcgcgcgcggtggccaggtcccgcccgtacggcttctcgatcaccaggcgggcgaacgaaccctcgttcgcctggttcagcccggcgccggcgagtccgcagatcaccggctcgaacgcgttcgccggggtcgacaggtagaacagacggttaccggacgtgccgcgctgcgcgtccaactcgtcgagcgtctcggccagacgcttgtaagtctccgggtcgtcgtagccgcccgacacgtaccgcacgccaccggccaactgtcgcttgtcggccagggtgcggtcgcccagggcgctctcggcgaactgctcgtcggacatcggcgtccgcgcgacgccgaccagtgcgaactggtcgggcagccggttgtggcgggccaggctctccaccgccggcagcagcttgcgccgggtcaggtcaccggacgcgccgaagatcaccagtgtggccggcggcgcgctgcgctcctggatgagctgaggttggtccatcgtctcgtcagtcctccgaccgttgttaccgtccgtctgaaccttacgcagcggccccctcggatggttcaccccgatgtgtgccgccgagcacaatgacaacgcttccctcgatgcacccaagacctaaccgataaaagtggcaaaatgggcgcaaaggtctggcaaccgaaggggaccccgtgaagtaccggctcgtgacccgcagcgacttcgacggcctggtctgcgccgtgctcctgcggcacctcgacatgatcgacgacatcatgttcgtgcaccccaaggacgtgcaggacggcgtcgtcgacatcaccgaccgtgacatcctgaccaacctgccctatgacgctcgcgcctaccaggtctacgaccatcaccactcggagaccatccgcaacgagggcgaccgcagcaaccacatcatcgacgccgacgcgccgtccgcggcccgcgtcatctacgaccacttcggcggccgggcccgcttcccgaaggtctccgacgacctgatgctcgccgtcgaccaggccgactcggccgactacgggctgaccgacattctcagccccaccggctggacactgctcaactttctgatggacagccgcaccggcctcggccgcttccgcaacttccggatctccaactaccagctgatgatgcagctcatcgacgcctgcatcgaacaccaggacgtccacgagatcctcgccctgcccgacgtggccgaacgcgccagcctgttccacgaatgctcggcccgcttcgtcgaccagctccaccgggtcacccacatggacggcgacgtggtcgtcgtcgacctgcgcgacgaggaggtcatcgaggccggcaaccgcttcatggtctacgcgctgttcccggacgcccgggtgtcggtgcacatcatctggggccgccagaaactcaacaccgtcttcgcctgcggcaaatcgatcctggaccgcacctccccggtcgacatcggcgaggtgatgctccgctacggcggcggtggccacatcgccgccggcacctgccaggtgccccacgacgaatcggaccgcgtcgaacgcgagatcatcgacgccctccgcaccgaacgggtggtgccggtgtaggcgccggtcgttcgcctggatcaagatcaaattcatgatgcggatgtcgtaggtccgcgctgataactgatcgccgctcccgccgaggccggatcacggcgatcaggccgctggtgcgccctgaacgatcgccgcgacccttcattgcccgcggctggtcaccgaaaaccttccccgccgcgtgagccgccccgcgccaccctcagtgcccgcgccgcccgtcttcagcgcctctagctagctaggcgccgccggccgtgcgtgggtcagtcccgcttgagcatcgtggcgagatcctccgccggcaccgcccgcgcgctcttcctgccgcatcgtcgtgtcgggcgggggcgtcgcgccgtgtcgtaccgggctcgcggcgcggtgatgcggggccgggtggtgagacgttcgggcgggtgaggaggggtcctcacccgcccgggcgcgcggatcacgggccttgcccggggccccacccgcctgtcgtggtacgcgccccacgcgcgtatccacgacaacctcacgcacacccgcgtgaggttttcccgctgcaggaccctgcctgcgtgggagtcttcgtcagcctttgaggctccagcggcccgccgggatgggctcgcggtcgtcgtcggtcgtttcgggtccgccgtccgcatccgccgaggcgggcgctgcggctgcactctccgccgcgatcccggcgcctccggccgggccgctgtcggcgacggcgatccgggcgctgtcggtcgtggcaccgggcacgctgtccgcgtcggcgatccgggcgtcgtctgcggtggcaccgggcacgctgtccgcggcagcgatccgggcgctgtctgcggtggcacccgggccgctgtccgcggcagcgaccggaatgccgtcggccgggccggccgaagtgccgccggaagcagcggaagccgtggtgtcaccgctcggggtggcggcggccggttccggggtttcgtcgggttcgtcgtcgggcgtttcgttggcgcggtggcggttgcggaggatcagccagccggcgccgaggagggcgagggccgcgacgatccagccgacgatgcccaggaccgaggcgccgcggtcgttctgttcgacttcggcgaccgcctggcggaacagttcgtcctcgtcggccgaagcggagtcgcccgcagaaccgccgcccgtggagcccgccgcgccgcccgtggaacctgccgcgccgcccgtggaacccgccgcgcccgctgccgtgccgctgtccgtggcaccggtggaaccgtggtcgtgggcggtcgccccggacgggtccggggtgagggtcagggtggcgggcatcgccggggcgggtttgccgtccgcgtacgcgccggtgagctggaacgtgatcgtgctcagcgtggggagcgggccgagcgcgacgctgaggtcggccgcgccgccgggggcgatggaggtgccgccgaccgcgatccaggtgatcgacttcgggacctgggtgaccggggtgccgttgtggatcgtcttcagcggggtgttgaggttctgccactcgatctggggcgcccagtcgtcgaccgagaggggatagacctcggcgatcggggtgtcggccgggatctgcagggtgacccgcgtcagcggccgggtgccgtcgttctcgacgtggtaggtcaggttctgcccactgccctgcggcacgctgggcggactgacggtcacgccggcgtacgccggaccggcggtcacgctgagcaccccggcggcggtcacgagagtgagcgctgttcccaaatacctcacgggagttagttcggatcacagcttccgatggttcaaccgcgctcagaagattttttccgcggccgggggtggcgacgagcgtcgggggcgggtgccggatgatggacggatgcgcgacgtgtcgatcaacggcgagatgatccggctggggcagttcctgaagctggccgatctgatcgacaccggcggcgaggccaaggtgctgatcgcgtcgggtgacgtcacggtcaacgacgaggtcgacacccgccgcggtcgccagctgcacccgggtgatgtggtcgaggtgctcggcaaccgggcccgggtcgtgccgtgaggccggctggcccagccctctgagctgggcggatccggctgacgtcggaccgccggaatatgatccactcttttgacgggtttcttgtccggaggcggaaccgcagcccccggcgtctcgtcgtatgagacatgacccgaacccgcggcctgctggccgccaccgccatccccctgatcctgatggccgggtgtgcccggccgggtgaggccggcagcatcaccgagagcgccccggcccccaccgcggacgccacggtcctggtccgtctcggataccagggcggtttcgttcctgagatctaccgtttcgttcggttgcccgaggtgacgatctacgccgacggccgggtggtcagcaacggtccggtgccggcggtggcacccggcccggcgctgcccaatgtgcagatcagcaagatcacgccggagcgggcccggcagtgggcggccgacgcggtcgcggccggggtgaaggacggcgccgacttcggtacgcccggcgtggccgacatcccggacacggtggtcaccgcggtcaccgacggccgggcgcagaccgtccacgtgacggcgctgcgcgagacgcgtccggatgatgcgcaggtcacggccgctcagaaagcggcccgcgccaagcttgcggcgtacgtcgacagtctgcgcgccctggccaccgagaccggttcgcccgccccggacgcctaccgccccgagtcggtggccgtgctggcgcagccgtatgtgccggtcgacgacggcctggagcagaagccggtggcctggccgggtccggcactgcccggcgcgacgctctccggcaccgtgcactgtgtggcggtctccggcgccgagctgaccaaggtgtgggccgccgccgccaccgccaaccagcgcaccccgtggacctcgggcggcaagcagtggcaggtgatgttccggccgttgctgccggacgagaccggtggttgcgcggctctgggcaaggcctcgtgatcccgttcagcggtgacgaatatgaccccgatgtgcggatgatccgcaggcccgctagcgtcggggaacgtgagtggaacggggatgctggcagcgcagatcctggtggcgctggtgctcctcgcggtgctggcgttcggcgggatggcggtcttcgcggggcggcggtcgccggtcacgcccgcgccggagccggagcccgaggtggtcgagctggagacgggcgccggcgaggtatgggcggcggcgcagcgtgcggcgcaggcggctgaccaggcgcgcgagcgggcgaccgaggccaatggtgagcgcgaccaggccgaggagcgctatcagcaggcaaaatgggattcctggaccggtccgaaggacgagggtcgcaccctggtcgagcgggccgccctggaggcgtaccgccgcggtgatctctcggtcgaccagctgaaccggatctgggcgcagacccggcccggtgaggacgaggtcgagcggatggaccaggagatcgccgaggcgaagctgcggtacgcggcggcgctgaccgaggcggtcgaggagcggcgggccgcgcacgtcgcggaggtggccgccgaggttctggcggaggaggcgcggctggccgaggagacggcgctggcggcgcgcctggcggcgcaggaggcggccggtctgtcgggactgctgcaggggcccggggagcatcccgggcccccggcaggtcagtgaacctcgaccaggtccaccacgaagatcagcgtctcgtgcggcttgatcacgccgcccgcgccggccgcgccgtagcccaggtgcggcgggatggtgagcttgcggcggccgccgaccttcatcccggccacgccctggtcccagccggcgatgacctgctggccgccgacccggaaaccgagcgcctgaccccggttgtaggaggcgtcgaactccttgcccgtcgactgggccacgcccacgtagtggacgctgacgtactcgccgggcttggcctccgggccggtgccctcgacgatgtcctcgatcacgagatcggcgggcgcttcgtcggggatgtgaccgacgtcgggcttgttcatgaatcctccagaatggtgttacctgactcggtcatgcaatcacaggcccgcgcccgctgaacgagcggtgccggatctgcgtatctcctgggtgaccgggaccgtcccggtcgtgtgatccgcctgggagtcagccgtgcgtctcttcgtcgttctggcggccgccgccaccctgaccgccgccgtgccggggacggccgcgttcgcgcacggggcgccgaccacgccgatcagccggtcggcggcctgcgccgggaacgggacgaagacgtcggccgcggcgtgcaaggcggcgaaggcggccagcgggggtttcctcggggcgttcgacaacctgcggatcgcggacgtcaacggcaacgaccgcaaggcggtgccggacgggaagctctgcagcgggggactcgacgcgtaccgaggcctcgatctgccccgcgacgacttcccgtcgacggcggtgcggtccgggcagaagctggccatcgcctaccgcgggacgattccgcatcaggggcagttccggatcttcctgagtaagccgggttacagcccgctgaagcggctgacctgggacgacctggggagtaagccgctcgccgcgttcaccgacccggcgttcagcgacggcgcgtaccacatgtcggtgacgctgccgcagcggaccgggaagcagatgttgtacgtcgtctggcagacctcgagcaccccggacacctactactcctgttccgacctggacttcccggccgcgccggccgtgcagcggtccaccgcggccgcgccggcgtccccggcgtccccgtcgtcgtccgcctcgccggccaccgccacgccgctcgccgtggcctcctcggccctagctagctagcacggacagcacccgggtgggccactggctgatcttcggggcgttcggcgcggcggtcgtggcgggcgcgatcgccctgggcagccgccgtcgccgccagcgatgacgggttttcgaaaaaagttttgaaccctcggttcgtggatcacgtaatcatcggcgtcgacaatgcaacgcccgtccggcccccaacagacgaaaggcccagcatgagtcgtagtcgttaccgcgcccaggcgttcccgcggttgaatcgccggcggatgctggcactcaccgccgcaggtgtcggggtctcggccgtttcggtcgccgggctcagtctcgccggcgagaactcgaccacgtctgcatcggactcctcgccgctcgtcatttcggtccgggatgccaagaaaggcactttcgacgtcttcgtgggagacgcgaagaagaccgtgaccgacaagaaactcgtcgcccagctgctcaaagctgccggccgctgatctgaggggactcggagaaaatgtcttcccaccgcgaagcgccggaaatcagcaaggacccggtcgccgacagttctgatctgtacgcgttcgtcagccccgacgatccggacacggtcaccatcatcgcgaactacgtgccgctgcagattccggcgagtggcccgaacttcttcgagttcggcgacgacgtgctctacgaaatccacatcgacgcgaacggcgatgcccggcccgacgtcacgtaccagttccgtttccacaccgaactgcgtaacgaccggacgttcctctacaacaccgggcagatcgagtcgctggacagcaagaactggaaccggcggcagttcttctcggtcaccaaggtcgaccggcacggcaagcagacggtgctggccaacaaactcccgtgcccgccgtgcaacgtcggcaagatctccatcccgcactacgcgaagctggccgagcacgccgtccacaagctgaagtcgggggagaaggtcttcgccggacagcgcgccgacgcgttcttcgtcgacctgggcgccatcttcgatctgggcacgctgcggccgttccagaacaagcacctggtcggcaagacgctgttcaactatgccggcaaggcggtcaacgccaccgacaagacgaacgtgcacagcatcgcggtacagattccgctgagcgcggtccggcgtgacggcaagaagcgggtgaaggcctccgacgcgggcgcggtgatcggcgtgtggacgaccgcgagccgccgcgaggtgcaggtccgggacggctcgaacgtgctggtcggcccgcaggtgcaggtgtcgcggctgggtaatccgctgttcaacgaggtcatcgtcccgatggcgcagaaggacaagtggaacagcctgccgccgagcgaggacaagaggttcgccgaattcgtggccaagccggagctcggctcgctgcttccggtgctctacccgggcctgttcgacaacctggccgccctgaacaaggccggcaaggaccgggcggacctgctggcgatcctgctcaccggcatcccgtccgggatcatcgacggcttccagaacaacaccggcagcctgcaggccgacatgctgcgcctgaacaccgcgatcgccccggccgcgaaacccaacgcgttcggtgtggtcggcggcgacctggccggcttccccaacggccgccggatcgccgacgacgtggtctccatctcgctgcgggcgatcgccggcgccaccgtgccgctggtcgacaaggcgttcaagccggacgccgcggcgtcgctggtcgagcagggcctgagcatcaaggacgtcagttcgggcctgctcaagaagttcccctacctcgggacgcccttcgacggattctcggtgccggcatgagccacgaccaccaccaccatcacacgctggccccgtccggacagggcaccgtgatgctcaacatcggcggccggatcggcgccctgatcatccacacctcggcccgtttccacggtcacgagatcgagatcagctcgtcggccgaccgcgacacacggcagcacgccgcggtccgcgcccgctacgtcggcggcggcgtcacctactgtgtggtcatcgacgcgctggccgagggaacctacctgatctgggccgccgacccggaaccgctggccaccgtcgaggtccgcggcggcgcggtcgctgagtacgcgtggccggagaacgccgtacccgggagaacgcttttgaccgtctagtgtgtagggatgtcggggggtgaggtcccggtccacgtcgcgctgcacaccagcgacgtggatcaggcccgtgccttctgtcgcaggctctactacgacccgctgcgcatcgaaccggtcggcgaccccggccggttcgatttcagcgccgacgtggtcgagctcggcccgatcacggtcggcgaggtcggctacggcaccgacatccgcgtcgcgatcggtgccctggaaacgtcgtaccacgtgctcgtcccgctcaccggcgtgctccggtcccggcaccgcggcaccctggtcgtggccgaccccacccgcgcggtcgtctaccgccccaccggcgacatcgagctggactggcccggcacctgccgcctgctgagcgtcaaggtcgaacgcggcgccctcgaacgcgaactggacgcggccctcgaccagcgcgtcgtctccccgctgccgctcggcgccagcttcgacctggtcgacggccccggccgcacctgggtcgccctggtccgcctcctgctgtccgaactccgcggcccggacgccctggccagccagccccggatggccgcccgctggcgcgacatggtcgtcagcggcctggccctcaccgtcgagcacccctacggcgacgaacccgccggcctccagggcccgcaccgcccccgcaccgtcaaacgggtcctcgacgccctgcacgccgagcccgcccgcccgttcacctcccacgagctggccaccatcgccggcgtcggggtccgggtcctgcaggacgccttccgccagcacgtcggcatggcccccatgacctacctgcgccgcctgcgcctggacggcgtgcacaccgaactctcccgctccgaccccgccaccaccaccgtcagcgaggtcgcctaccactggggtttcacccacctgagccgcttcgcgggcgcgtaccgcgcccgcttcggagttcccccctccaccaccctccgaggccgcccgtaggtgccggtctccggtgcggcatctccttctcggatgctcatgccacaatgccgcccatgatccggatcgtcatgggtgcgttggttcgcgacgatcagatgctgctcgtccatcgaagtccgagccgccctgtccacccggacgtgtggagcctgggcggcggccacatggagccgggcgagacggaactggccgcgctcgccagggagctggacgaggaactgggcgtgcagatggtgccgggctcggcgatccatctgtgtcggctgcaggtcggccgcggaggggaagccgtgcacttcagcgcctggatcgttgaggagtgggaggggaaaccggtgaatgccgcccctgaagagcacgacgaaattcgatggttccgacccgcggagctgcctcctctcacccccgaaccggtacgcacggcgctgatcgaggcgatgcggaacacccgcgcctgagccaccggtccgggccgggctcagtccgccacgaacatggcgatgtcgtggccgagtgacgtcagggtgaagagggcgtacacggctgtcagggccgcggtggtgagcgaccacctgaacaagcgcggcggcacggtgtgccggagaccggcccatccgctggcggctgcaccgatcagtgccagcggtacggcgagactcgcaccccataccgtgatgtagtaacccggcgacccgagcagcagccccggaaccacccacagccaggtgggcgggtactgccgtggggcccacaggtacgggatgatggcagccgccaggtaggccgcgagcacgtacagctgtacggcgaccaccgttctgacccagggaaccgacaggcggacttccgatccgtacccactgtcgacatgtgccacgacggttctccttgcacctcggggaaattccggctggttcgccgaccgtcccatgacagtaggggtcgagatccactcgccggatcccccgtggtcagcccacgaaaagccgacgtttggggccgggtgcgggcagtgacctgccgggcgcgaccgcggtgaacgccgccgcggtggcaccggatggtccgctctacggtcacgaactgacgcgagccgaagcactcgcccacccgagagccggcggatttccgcgtccgtgccggccgccgcgctgccgtccgcatcggtcccgctgtatctcgtggcccggtacgatgccgggatctgatcatgatcccgagttgcgcgaggaaggccgcaccattgttccgtgaaggcttgagaacgagggcctgtcgccccagcccggtggtcctggccgtcgccgcgcttcaggtggccgccgccaccctggctctgcccatcgccactcccgcggccgcccaggccgccgcgccgtaccggaaggtcggctacttctcccgcgccgccgtgaagcccaaggccgagggtggcgcggacttccagatccgcgacctcgacgagaagggttccgcggcaaagctgaccagcctgcactacgccttcggctccatctcggcggccggcgaatgccagatcacgagcgacgaggcccggctggactatcagcaggagtatccggcgacggacagcctcgacggcgtggcggaccagccgggacaggccctgcgcggcgtcttcaaccagatccggcggctcaaggccaagtactcgctgcggacctccatctcgttgggcggcggatccgggtcggcgaacttcgccgaggcggccaggaccgcggtctcgcgggagaagttcgtccgatcctgcatcgatctctacatcaagggcgaccttccgcagctcggcggccagccgcagggcgggatcggggccggcgccggcgtcttcgacgggatcgacatcgactgggagtacccgggggcaaccgggaactccctggagaagcacaactacaccctgctgctgcaggagttccgacgccagctcgacgcctaccggcagggcgccgagggccgaccgtactatctgctcaccgcggcactgcccggcggcgcctacaccctgggccggggatacgaactgccggcgatcttcacctacctggactgggcggtgctgatggcgtacgacatgcacggcgcctgggaaagcccgtcgaccaccaaccaccagtcggcactgcacctgaatgccgccgaccccgacccgaccgatcgcagcgtcgacatctacctcaagaatctcaccgaccatggcgtcgccccgggccggctggtgctcggcgttcccttctacagtcgtggctggaccggcgtcgacgccaccgacaacggcctgttccgtcccggtaccggcgtctccgacggccgggactaccgaaccgtcaaggagtacgtgcacaacggcttcgtccggcactgggacgacaccgccaaagcggcgtggctgttcaacggcaacaccttctggaccttcgacgaccccgccgtgatgacggagaaggccgggtacgcgaaggcggccaagctcggcgggatcggcgtctgggcattgaaccaggacgacgaccagggcgccctgctggccgcgattgacagcggcctgcggtaggccccggcgttcccgacaccgctcgccgaccttgatgcgtcgagctcggcgggcggtgtcgagcgcggtcggggctgtgcgatcatggggccatgatgatcagaaaggcccatggccgctgaccgccggctcgcgcttcacgcgacgctcccggatcgttacgcccatctcgaggtcatggcctcgactatcgatcatgacggtcggctcgtcgtccttctcgccgatccggcgcagggcttcgtggcggtcccgcacctgaccgagctgcgtccgccaccgctttacgatgcgaccgccctcatctgtgcggggctcgaggttcgtgagatcccgctgaagggcctcgacctgtggttctccggcatcgactcgctcggcgacggcgtcgtgttgtccgccgcccgatgtgctgcacccggcgtctgcgaggaacgctacggcgaaccggtgcccgaggaggatctgaccctcaccgcgaacgtgcgggtcttcgacggtcacggtcgggcgcaggcggcgttctacgccggagacggtatcgagcagctcgtgaccgacgcgcgagggcagatctggatcagctacttcgacgagtcgaactactggtttccccactcggacggcacccgctcgtacggcttcatgatcggtctggcgcggtgggacggcggcggcggcgaaccctggatggtgtcatccggcacccctaccctgccgtggtgcgactgctacgcactgaatgtcggacgcgagcggatccgcgcgtgcccgtatcccgacttcgccgtggtcgagctcgacgcgaacagtgtccgggccgtcgtcgacaaccccatcacccgttgcaccggcctcgccgtcgtgggtgcggagttcgccttcttcgatcagcaccgggccggcgacgggttccggtggggcattcgtcgcggccgtcaggatggggagcgcatcattgagaccggccgcgagcagctggaactgccggacggccggcagccgtcgggctgggctcggggcagggtcggccgtgacgggatgctgtggttgcggatggacggtgaccccggtcgttggtaccggtacgacatcgatgcgtgaggccttcgccccgccgctacccggtcgccggcgacggatgcgacgagcccgggaccgcttgggtggccggccgcggttttccgtaccaccagccctgtcccagatcgcatccgttggcccgcagccagtcgtgctgcgccgccgtttccacgccttcggcgaccacccgatggccgagcgcccgcgacatggccagtaccgcccgcacaatggattcgtccgcgccgcccagccccaccccggagatgaaggcgcggtcgatcttgacgatggaaaccggcagccgctgcaggtagctcagggacgagtagccggttccgaaatcgtcgatgcacagtgtcacgccgagggcgcgcagctggtgcagcgcgtcgaggcacgtgtccaggtcggtcatcaggccggattcggtcacttcgagccacagcccggccgcgggcagtccggtgcgcccgaggacttcgcgcacccgttcggccagatcaggttcccacaactggcgtacggcgaggttcaccgacacgtgcagggccgggttcccggcgcgccacgtgcggagttgccccgcggccttctccagcagccaggcgccggccgggacgatcagcccggtgtcctcggcgaccgggatgaactctgccggggacaccgttcccagcgtcgggtgggtccagcgcatcagcgcttcgaagccgtcgacctgcccggtcggcagatcgatgatcggctggtagtgcacgtcgagttcaccgtttccggaggccccgcggaaggcgcgttccagcgttatccgggtgcgtacccggtcccgcagttcggggtcgaagaccacggcgcgacggcgtccggcatctttcgcccggtacatcgcggtgtccgcgtcccggatcagttcgaccgggtcgggccggccgggggagtgcgcgatcccgatggaggcggtgacgtcgaccgccccgacggacagcggcaccggttcggcgagcactgtcagcagccgcccggccagggccgccgggtcctcggcacggaccgccacgatgaattcgtcggcacccacccggcacacgaggtcgtcggcccgggtttccgcactgatccggtgtgccaccgcgcgcagcagttcgtcaccgacctcgtgcccccagtggtcgttgatcagccggaaccggtccaggtcgaggaagagcacactcacgccgggccagtccgcgatggtcgacgtcagcaggtcccggttgggcagcccggtcagcgcgtcgtggtcggcctgccagcgggcccgctgttcggcgcgggcccgggagttgttggcacggacgatccgggacaccgcgatgaagatcagcgtcagcgacaacaccgcccggaccagcgcgaaccgcaggccgtgcgggggtgctaccacggtcagcacggtcggcgcgcacagcgccgcggtgatcgccgcggtgcgggacatccggagttgctgtgaccggttcggcaccggctgggtgagtaccaccacggtcggatggagcatgcaggcggagttcgccgcgtacgcgatcagggccgccgcaccgacctcggcgagcgggatggtccggggtccggcatcgaaccagccgcggaccgcgagcacgatgtcggcggccagcagggccgtcgcgctgaccgagaagaaccacatcgcgggcgcgccggtgcggcccagcagcagcatcggcaggacgatcatcagcaggccggcggcgaccagcggcagcgccgccgcgaccaggttctcccagtgcgggtcgtgtccggcgaaccacggctccatccacagcgaccagaccaccagcgccgatccggcgcccagcaggatggcgtcgacccgggccggttcgtcggcaccggcccggctgcgccgcagcaggtcgatcagcccggccccgagcatcaggtagctgaccagcagcatcacgttcggaaacaccgtcgcgtgcgccagcgtccgcgccgcctcgccggccaccgcgccggcctgcgccgcgagcagcaggacccagggccgccggcgccccgcgccgaggttcttcccgatgccgaaacccccggcaaccacgcagatcaggaccccgatcaggtacgccgtgggcgcgatccgtggcccgccgaatccgatcagcagggcgccgggcccactgagcgccaccagcagccacgccgcccggccccgtccggcggcccctgtcggcggcgacccgtcgtcgctcacacctgcgattctggcaccactcgcgccgtcttcacccgtattgcccagccttgtccgacggcggcaccgcccggtcccggaggacgacggcggcaccgcccggtcccggaggaaccgccgccccacctcggccggcgccgccacgtcgtcgtcgctcatcaccggcgtggagaacggcgagtccggcacctggccaggcgccggcgtcgggcccggccgaccacggccgggccggtgcgcgtaccgccgcaatcggcttctaaagctcgatccgctgtcccttgccgatcacgaccaccccgttgtcgctgaccgtgtagagcttgcggtcgcggtcgaggtcgacgccgatctgcgcgccctccggaatggtgacgttcttgtcgatgatcgcgttgcggatgaccgcgcggcggccgaccgagacaccctccatcaggaccgcgccgtcgacgtgggcccacgagttgacgcgcacgttcggcgagatcaccgagcgttcgacgagggcgccggagaccaccacgccgggggagatcatcgagtcgatggcgcggccctgccggtcgtcgtagccgtgcacgaacttggccggcggccacgagccgtagttggtgaagatcggccactcgtggttgtacaggttgaagatcggcagggtggcgatcaggtccatgtgggcctcgtagaacgagtcgagcgtgcccacgtcccgccagtacccgcggtcgcggtcggtggccccgggcacgtcgttgtcgcggaagtcgtagacgttcgcctcgccgcgctcgaccagcatcgggatgatgttgccgcccatgtcgtgcttgctgtccgggttctgcgcgtcggcggtcaccgcctcacacagggcgcgggtggtgaagacgtagttgcccatcgacgcgtagacctcgtcgggggagtcggccaggccgaccgcgtcgcgcggcttctcccggaaggctttgatcttcttgccgtcggggccgacgtcgatcacgccgaactggtcggcgagcgacagcggctggcggatgccggcgacggtgaccgcggcgcccgaggcgatgtggtcgttgaccatctgcttcgggtccatgcggtagatgtggtcggcaccgaagacgatcacgtaatccggcgactcgtcgttgatcaggttgaggctctggtagatcgcgtcggcggagccggcgaaccagcgcgggccgagccgctgctgcgcggggaccggggtgacgtagttgccgagcagcgtcgacatccgccacgtcttggagatgtgccggtcgagcgagtgcgacttgtactgggtcagcacgacgatcttgagataaccggcgttggcgaggttggagagaacgaagtcgatcatccgatagatgccgccgaacgggacaccgggtttggcccggtccgccgtcaggggcatcaggcgcttgccttctccaccggccagaacgatcgcaagcaccttgacagccatgggaaggacgctaatatccgggccgctagttcgccacccaaagtgtatcgctacttgattaagcgacggtggcgctgctctctctgatccatgactcgatcgccgcgggctcggccggacggccgaaatggtagccctggacgaggtcgcaccgcaggtcacgcagcacggccgcctgttccggggtctccacgccctcggcgacggtgatcagaccctgactgcgcgcgagttccaggatcgccttggtgaaactgacatcgctgatgaacgaacggtcgatcttcaggatgtcgaccggcagctgccgcaggtacgccagcgacgagtagccggtgccgaagtcgtcgatcgcgatccggatgccgtgctcgcgcagccggcccaggaccggggtgtcggccgcatcgatcagcaccgactcggtgatctccaggaccagcccggccggcggcagaccggtctcggcgaggatcgccagcacggtgtcggcgaagtccgggtcgcgcagctgatgggtggagacgttcacggtcacgtagatgccgtcccggcggtgccagccggccgcccgggcgcaggccagtcgcagcgcccgcagcccgatcggcccgatcagcccggtctgctcggccaccgggatgaacaccccgggcggcaccagctcgccgtcgcggcgccagcgcatcagcgcctcgaccccgctcatccggccgctgaccgggtcgaccaccggctggtagtgcaggaacagcgtctcgtcggcgagcgcctggcgcagcccggccgcgaggcacgcgcgctcgctctgctcggcgcgcagccgctcgtcgaagcgggccagccgggctccgccggccagcttggcggcgcgcaacgcgaggtccgcgtcacccagcacggccgagggcggattgccgggtacgccgtcggccacccccgcgctgccgcagaggtggatccggcgctcgtccacggacaccggcacccgggagatcgtgtcgagcacccgcgcggccaggtcggccgcccccgccgggtcggtgagcagcagggcgaactcgtccccgccgagccgggccaccagcaccgcctcgggagcgaacagcagcagccgcccggcgagctggcgcagcacctcgtcgccgaccgggtgcccgtaggcgtcgttgaccgccttgaacccgtcgagcgaacagagcagcaggcagtgcggccggtcccggaccgccggggtggccagctgctccagcagcagctcccggttggccagcccggtcagcgagtcgtgcccggcccggtaggccagcttgcgctgcaacgcggcctgctcgtcgaccgcccggcacagctcggcggcccggtggccggcgtcgcgcgccagcatgcagatgcgcagcaccagcagcccgcacagggccgaggtgagcagcgccggcacccaggtcgcgacgtcgtgccgggcggtgagcagcggcagcatcggggcgagcacggcgatcgcgatgatccgggcgagccggccccggctgacctcggtgccccgggggtcaccggtgccgagcgcgcccgcccgggggtgccgggcggccgcggtgaccagcaccccggcgtactggatgagcaggaacgagccgccgccgggcaggaacgggccgaccccggccgagctggtcgcggcgtacagcatgtgcgcgccgagcagcagcgcaccggagccgccgagcagccgtgccggggcgccgtgccgggaggtcagtccgcgcagggtggtggccagcagcgccatgtcgaccagcgcgtacagcgcggccagggcgctgtcgacctgctggtagccgggcgcgcccagatacggcagcaccacgaacgaccaggccagcatggccacgccgagcaccaccgcaccggcctcgacgctgatctcggcccggctgtagtggcggccaccgcgccgggtgagcagcgccgcgccggccgccgacaacagatagagcgggacgaggctgaagccggtcggggtgttggccggcgggaccgggccccacatccagaacgcggtggcgaccaccgcggcgacccgggcgacggtctgcagccaccagccggcgcccagccgcaggcgcagtgtggccccgatcgtggccacctggatcagcaggaacagcacgccgctgccggtcagctgggcgacggtgaccgccaccgcgccggccaccagcacgtaccgccaggctcctggtccgctccactcccgcacccggccattgcagcccacggcggttgccggacgggtgccggaccgggtcgccgcgggttgcggtgggctattgtgcggggcgtggctctgcgtgtggacctcctgacccgtgaatatccgccggaggtgtacggcggcgccggcgtgcacctggaatacctgaccagggacctgcggcggctcgccgacgtgcgggtgcactgcttcggcgcaccccgcaccgaggagggtgtcaccgcgtacccggagcccgccgagctggccggggcgaacgccgcgctgcgcaccatgggggtgaatctcgccatggcggccggcaccgccggcgcgagcgtcgtgcacagccacacctggtatgcgaatttcgccgggcacaccgcgaaactgctgcacggcatcccgcacgtggtcaccacgcacagcctggagccgctgcgcccgtggaaggcggagcagctcggcggtggctacgcgctgtcgtcgttctgcgagcggaccgctgtcgaggccgccgacgcgatcgtcgcggtctccggcgggatgcgccgcgacgtgctcaaggcatacccgtcggtcgaccccgacaagattcacgtggtctacaacggcatcgacactgatctttacgtgcccgccgtggaaacggacgtgatcgaccggctcggcatcgaccggaaccggccgagcgtcgtcttcgtgggccggatcacccggcagaagggcctgccgtacctgatgcgggcctgtcacgacctgcccgccgacgcccagatcatcctgctggccggcgcccccgacaccccggagatcgccgccgaggtcgctcagctcgccgccggtctccaggagcggcgcagcggcgtcgtctgggtgcaggagatgctgcccaagcacgaggtcatccaggtgctcacgcacgccacggtgttcgtctgcccgtcgatctacgagccgatgggcatcgtcaacctggaggcgatggcctgcgagaccgcggtcgtggccaccgccaccggcggcatcccggaggtggtcgccgacggcgagaccggcctgctggtcccgatcgaacaggtcgaggacggcaccggcaccccggtgcacccggagaagttcgtcgccgacctggccgccacgctcacccggctgctccaggacccgcagctcgccgagcggatgggcaaggccggccgccgccgtgccgtcgagcacttcagctgggcccggatcgccgaggacacgatgaccgtgtaccggtcggtgctgtgacccgagtccaacgcctgcgcctcggtctgctgctgtcggtggtcctgatcgccgcactggcgatcggcgcggggttggtccgggccgccttctaccgcgcgtcggcggcggccccggtcaccggtccggccgccgcggtcgccggcaccgtcgcgcagtgcgccgggcagcccgcccgggccgcccgtgagctgcgcggcatgtggctgaccacggtctacaacgcggatttccccagccgcccggggcttggtgaggaccaggtcaaggcggagtacgagcggtggctcgacctcgcggtggcgcagaaccacaacgcgatcttcgtgcacgtacgcccgagcggggacgcgttctggccctccgcctacgcgccctggtcgaactggctgaccggccggttcgacggcaggtcgcccggctgggacccgatggcgttcatggtctccgaggcgcacgcccgcgggctggcgttccacgcctggttcaacccgtaccgggggacccagccggctcccggcggcatcggcaccgacgccgccaaactcgcccccaaccacccgctgcgcctgcacccggagtggcgcatcgcgtatccgaccggcaggaccggccgtttctacttcgatccgggcatcccggaggcgcgtcggttcgtcgaggattcgatgctggaggccgtgcagaagtacgacgtcgacggcgtgcacttcgacgacttcttctacccgtacccggaaggcagcggccaggacttcccggacgccgcctcctaccagcggtacggtgccggaaagtcgaaggcggactggcgccgggagaacgtgaacaccctggtccgcgagatgcacgagcggctcctgcaggtcaaaccgtgggtctcgttcgggatcagcccgttcggcatctggcgcaaccgggccaccgatccgttgggttcgaactccgccggcctggaaagctacgacacgatctacgccgacacccgtaggtgggtgcagtccggctggctggactacgtggccccgcagctctactggacgatcgggttcagcaaagccgactacctgaccctgctgaaatggtggaccgacctgacccggggcacccgggtgcagctctacatcgggatggccgactaccgggtgggcgagccgggagactggagcgacccggcgatgctggaccgggagatggcactgaaccggaaatacgccgcccagggcgagatccacttcagcgccggccaggtgcggggcgaccggctgggtgcggtcagccggtatcgccgggcctactacgccacgccggccctgcagccccgcctcgaccgcctggccgcacccgccccggcgaccccgcgcctcaccacggcccgccccggcccggccggccggctgatcctgacggcgaccgggctgggcgcgacgaactggtcgctgtaccgcaccacgggcggcccggccaccctggtcgccaccggccggtccggcgccgagatcgccgacccgcacccatcgggaaaggccacctactgcctgggcgcggtggaccggtccggcacggagagcccgctcagcccggccctgtcgagctgacggctgtcccgcggcctcgtcatcggtgctgtcgagcaggctgtcgcctggtaggaagattgccatggtccagatggaccccctcagcgcacgtcccgatggacgacgttccgtcttgtcgacgactccgagccgcccgacccaccgggcctgagcgcgcccgatcacggctccccggcctgacgggttctgcacctccggcggctttcccgaggacggcgtggtggtcggtgacggctgctggacctcctccggtgggcaagcgtttcggtgaggtgggcagcccggctgcgggcacatcgggggcggagagacgcttaggtttattgcaagttctttcttcggtggcgcggcgtgtcatcagcagccgattgtggcattctggtgacgcattgacgcaggtcacagatttgttgggataggcaacgaacaattcctaaatcgcctattcggacaaataggcttgacctgacgacgctgtcccaccactgtggatgacgcctaccgcgcaagttctggaagtacttgcaatcagcggtgaggatcatcaaaggggactgtcatgaatcgcaccaccgttcgggccggcgtgctggccaccgccctgatcagcggcgtgctcggggtggccggcccggcgctcgccgccccggtcaccgacgcggcgccggtcgccgccgccggcaccgccgtcgcgccgatcgccgcgaccttcaacgtgaccgccgggttcaccagctggggtcagaacgtctacgtcgtcggcagcatcccggcgctcggctcctgggacgtctccaaggcggtgccgctgaccaccacgagcagcgccttcccgacctggaccgggagcgtggcgctgccggcgaacacgtacaccgagttccagtacgtggtgaagaacgccgacggcagcgtcgcccgctgggagaagggtttccagcagaaccgcaccacgatcaccccgccgaccggcacctacgtcacgcacgacaccttcggcgcgtactgatccgcagtggtcgcgccgagggatatggctcagatacccctcggcgcgacccccgcagtatcgcatcgggcggctcgtgggttacgcgcgagcgagcgggccgccggccggtcaggcgaaggtgacctcgaccagcgggctcttcgccacccagacctcctgttcgaggcccggcttgctggtgaactcggtgagcggggcgagcagcccggtgaagaccttctcccgctcggccgggtcggtgatcgggcgggcgacggccggtaggtcggcggtggcggtctccttcagatggaaggtgaaggccgggttcgccaccaggttggcgtaccagtcgcggggcttgaccggggtgccggtgatgtaatagcggccgtcgagccggtggaaccagatctcgatgcggcggggctcgccgctcctgcgcccgatcgtggtgatgtcgatgacccggtcctgcgccagtgcggtggcggtcgcgtcgctcatgcctgctccctcgtgcggaaagcgtccggaaatcgtccttcagcgggaacctcggccgaggcccttctatttccgaccgcggcggaaggaattaggcgacccggcagtagagccggcgccgggaacgcgccaggccggccacggcgtccagaatctcccgggcgagttccgggtccagctcctcgccgtccccggcgcgtgccgcgacccactcccggctgaccgtgtccagggtgcgccggtcggccgcggccagcgccttggtgacggccggcaggaagctgaagatcagcggctcgtcgtcgttgatctgctccgggccgtcgacgtcgtccagatcgcgccgcagcagcaggctctcccactcctccagggaggcgaagatgtcgaagttcccgaatgcgaccgcgtcgcggccgggaccgtggtcgtcggcggcgtcgtcgttcgcggcggtgaagaaggtgatgatcgtgctcatggggatcagccggtgaccttgccgtcggccacctcgaggtggcggttcgtggcgaccgcggacagcatccggcggtcgtgggtgacgaggagcagggtaccgggataggtcgccagcgccgactccagctgttcgatggcgggcaggtccaggtggttggtcggctcgtcgaggaccagcaggttcaccccgcgcgcctgcagcagcgccagtgccgcccgggtgcgttcgccgggggagagggacccggccggccggttgacgtggcccgcgcggagaccgaacttcgcgagcagcgtgcgtacgtccgcgtcgttgaattccggaaccgcgtcgccgaaggcgcgcgccagcgtctcggtgcccaggaacagcccgcgggcctggcccacctcgccgaccaccacgcccggcccgagcgccgccgagccggcggtcagcggcagccgcccgagcagcgccgcgagcagcgtcgacttgccggacccgttggccccggtgatcgcgacccggtcaccccagtcgatctgcacggtgaccgggccgagggtgaacgagccgcggtcgacccgggcctcgcgcagggtggccaccaccgcaccggcgcgcggcgcgacggcgatctccatccgcagctcccactccttgcggggctcctcgaccacctccagccgctcgatcatcttttccgtctgccgggccttggcggcctgcttctcgctggtctcgccgcgcaggctcttgccgatcttgtcgttgtccggggccttgcggcgggcgttgcggacccccttgtccatccaggcgcgttgggtgcgggcgcgctcgagcagctcctccttcttgtcggagtactcctcgtactgctcccgggcgtgcgaccgggcccgctcccgctcctgcagataggacgcgtagccaccgccgtacaaccggatctgatgttgatgaagatccagttcgaggaccttggtgacggtacgggtgaggaactcccggtcgtggctgaccaccacgagccccccgcgcagcccctgcacgaagttctccaggtgggccagcccgtccaggtcgaggtcgttggtcggctcgtcgagcaggaatacgtcgtagcggctgagcagcagcgacgccatgcccgcccgggccgcctggccgccggacagggcggtcgtcggcagctccagatcgatccgcacgtcggacgaggtgagcgcgagcgcgcgttcctccaggtcggcgccgcccaggtcgagccaccgctccagagcggccgcgtaccggtcgtcggcaccgggagcgcccgcggccagttcctcggcggcggtgtccatcgcggtctgcgccgcggcgaccccggtgcgccgggccaggaagtcgcgcaccgtctcgccggcccgccgctcccgctcctgcggcaggtagccgacattcgcggtgggcgggctgagggagacggtgccgctctcggccggcagcaggcccgcgagcgtgcgcagcagcgtggtcttgcccgccccgttgacgccgaccaggccgatcacgtcgcccggcgcgaccaccaggtccagcccggtgaacaggtggtggtcgccgtgcccagcggcgagatcccgggcgatcagtgtggcgctcatcagtcagtcatctaagcacaggccccggctgaaccttcatgacggcgagtcatcggccgatcacccttgcgtgagaaggctggagcgggtgatggtgcgtgatccgatcacgctcgccgcggtcgcgtggacggcgctcggcctggtgctgctgttcgcgctggccggccactacaattcccaggtccgggtgttctggctgttccagccgccgctcgacctcctggtggcgtattcctcctggcgggtcagccggatcgccaccggagccgtcggtcgtttctggcgcatgctgatggtcacctccgccctgttcctcctgggcgactcggtgcagtccgtcctgtcgctgacccggcagcaccagtggtcgaccggcggcggcgtgatccagtcggtgtgcttcggcaccggcgagctgctgatcatcgtggccatgctgatccacccgtaccccggccggtcccgtcgtgaggcgctggccttctggctggacagcgccacggtgatggtcggtggtgcggtggtcacctggtccttcgcgtccagctccggcccgcaggacgagaacgccagcccgatcggcgcgctggtgggcgccgcggtcgcgctgaccgccggattcgcggccgtcaagatcttcctgagcgggaacgcgccgatgcacaaggcggccgccgtcccgatgatcggctcggcggtggtgatcggggtcagcgtgttcgccgccccgccctcgacgcaggacgggttgccggcgtacgtctacgccctgcgcttcgtgccgtcgctgctgatcgccgtcggcccgcggatccaggagatcatcgccggattcgaccagaccgcgttcggcgcccgccgccggcgcccgtacagcctgctgccgtacggctcgatcgcggtcgtcttcaccaccctgctcgtcgtgctgccgcagggctcgacccggcgcctgtggggcgtggtgggtggcctcggggtgatcgtcgccctggtagtggcccgccagctggccgccttccacgacaacacccgcctgatcgaccagctcgacagcaccctcaccgaactgcgcgagcacgagcagcggctgcgccaccaggccctctacgacgagctgaccgggctggccaaccgcgcccacttccgggaggagaccaccaccgcgctcgaggacgcccacccgggcagcgtcgcgctgctgctggtcgacctggacggcttcaaggcggtcaacgacacgcacgggcacggcgccggcgacctgctgctcgccggggtggccgagaagctgcgccagtcggtgcgggccggcgacctggtggcccgcctcggcggcgacgagttcgcggtgctgctgcgcgactgcacggtgcgcgacgccgagcagaccgcgcagcgcatcctgcgctcgatgaccgagccgatcgacgtcggcgacctcgcggtctgcgcgaacgccagcatcggcatcgcctgcgccgaggagcgcgacgacgtgcgcaccctgctgcacgacgcggacatggccatgtacgcctccaagcaccagggcaagggcacgtggaaccggtatcaggacgggatggccctgaccggtcactgaccgatcggcaccgcgtgcccggacacccgcaccccgggttcgccgggcaccagccggacggtgatccggctgggccggcccaggtcgtcgccctgccgcacggtgagcgtcgcgtcgtccgcgaccaggccgagctcccgcaggtagccgccgagcgccgcggcggccgcaccggtcgccgggtcctcgtagacgccgccgaccgggaacggatcgcgcacgtcgaaggtctgcggatcggcgcggaacaccagctgcacggtggtccagccggcctcggtcatcagcgctttcagcgccggcacgtcgtagtccaggtccgcgagccgctcccggccgcggacggccaggatcggatgccaggcgccggcgtacgccacccggggcggcagccccgggtcgaggtccgtggcggcccagcgcagcgccgccagcagcgcgctcaccgcgtccgcgccgagcggctcgacgcgcggcgggacgctggtcagcgtggccaccccgtgggtgtcgacggtcaccggcacctcaccggcgttggtcaggaacacatgctcgcccggccccagcgcgaccgcggtggccaccgtcgcgtgcccgcagaacgggatctcggtgagcgggctgaagtagcgcacccggtaccggtcgccgtcgcgcgaggtgacgaatgcggtctccgaatagcccaggtcggcggcgatcgccagcatccgggcgtcggacagggcggcggcgtcccggaccaccccggccgggtttccgccggccggatcggtggtgaacgcggcgtacgactccatcatggtgacgactctgccgcgcgccgcggccgtgacctaacgccaatctcgcggcgctggccgcgttcgcgatcacagtcgccggttgtcccgtctgcggagtagcgttcctgcggtgacagagggtcctaccgcgatcatctccgaaactcccgccgacctgccgcgcaccctgggcgagctgcgtgccaccgggcacgagttccgcaccgtgaaagaggagctgcgcgacaacctgctcgacaggctgcgctccggcgagccccgcttccccggcatcgtcggctacgacgacaccgtgctgcccgaggtcgagcgggccctgctcgccggccacgacatggtcctgctcggtgagcgcggccagggcaagacccgcctgatccgcgccctggccgggctgctggacgagtggacgccctacatcaccggttccgagctgcacgaacatccgtatcacccgctcaccccggcgtcgcgccggctggtcgccgaggccggcgacctgctgccgatctcctggctgcaccgctccgagcggtacggggagaagctcgccaccccggacaccagcgtcggcgacctgatcggcgacgtcgacccgatcaaggtggccgagggccgctcgctgggcgacccggacaccatccacttcggcctggtgccgcgcaccaaccggggcatcttcgcggtcaacgagctgcccgacctggccgagcggatccaggtgtcgctgctcaacgtcctggaggagcgcgacatccaggtccgcggctaccagctgcggctgccgctggacctgctgctggtcgcctcggccaacccggaggactacaccaaccggggccggatcatcaccccgctcaaggaccgcttcggcgccgagatccgcacccactacccggtcgacctggagctggagaccgcgctgatccggcaggaggcggcgctggtcgccgccgtcccggagcacctcgtcgacgtgctcgcccgctacacccgcggggtccgcgagtcgtcgtcggtcgacgcccgctccggcgtgtcggcccggttctcgatcgcggccgccgagacggtggcggcgtccgcgctgcgccgggccggcctgcgcggcgagcgggaggcggtcgcccggatctgcgacaccgtgtcggtcacctcgacgctgcgcggcaaggtggagttcgagagcggcgaggaggggcgcgagaccgaggtcctcgcccacctgctgcgggtcgccaccgccgagacgttccgggcccggctcgccgggctcgacctgtccggcttcaccgacctggtcgccgagggggcgatcatccagaccggtgacctggtcagcgccgaggagttgctcacccagatcggcacggtgccggggctggccaaggtgctcgaccggctcgggctgggcgacgcgccgagcccggggcaggccgcctccggaatcgagttcgtgctggaggggctgcatctgacccggcggctggccaaggagatgaccgacgacggccgcaccctctacgggagctgacgatggcacgaaacgtcttccggtacggggcctggcgggacgggccggacccgctcgccccgccctacgacgtgcgggccgcggtcgacgagatgggtgagcgggtcatgcggggcgacagcctgcgcgacgcgctgcgtgacctgatccggcgcgggccgcgggacggccgcgggctcgacgatctgcgcgaccgtgcccggcggctgcggcgggacgcgctgcgccggggaaacctggacggcgcggtgacccgggcgcggcagatgctcgaccaggcgctcgccgaggagcgggacaccctgcgggcccgggacgacatggagtcccggttcaacgaggcggtcctggacaacctgcctcggtccacctcgcaggccatcgcggaactgtcggagtatgactggcagtctccggaagctcgcgacatctaccggcagatcctctccgggctccgccgggaggtggtcgagcagcgcttcgccggcatgcgcgacgccctgcgcaacggtgacttctcggaggtgtcggagatgctgggcgacctcaacggtctgctcggcaagcatgcccgcggcgaggacaccaccgacgcgttccagcagttcatggagaagcacggccgcttcttcccggacaacccgcagaacgtcgacgagctgatcgactccctggcccgccaggccgccgcggccgagcggctgatgcgctcgctgagcccgcagcaacgcgaggaactgcagagcctgatggaccaggcgctcggcgacggcccgttgcggggacagatgagtgagctcaccgacaacctgcgggcgctgcgccccggcctcaactggggccgcggcgagcggatgcgcggctccgaggacctcggctacggcgacgcggccgccgccctgggggacatcgccgacctggacgagctgatcgaccaactgggccaggagcacccgggcgccaccctcgacgacgtcgacgtggaatcggtcgaacgccagctcggccggtccgccgccgacgacctgcgccgcctccgcgaactggagcgggagctgcgccggcagggctgggtggaacgcgacggcgacgggctcaccctgtcgccgaaggcgctgcgccggctgggccagaccgccctggcgaagatcttccacgacatcggcggcaagcgcggcgaccacgacatgcgtgacgcgggcgcggccggcgacctgatcggctcgtcgcgccgctgggagttcggcgacgaccagccgctcgacgtggtccgcacgatcggcaacgcggtccgccgccgggccgcttcgcgcgacgtcgccaccctgcccgtacggctggctccggaggatttcgaggtagccgaaaccgaacggcggtcctccgccgcggtcgccctctgtgtcgacctctcctattcgatgtacgccgacggtcgctggggcccgatgaaacagaccgccctggccctgtcgcatctggtcgccaccaggtatccgcaggacgcgctgcagatcatcggcttcggcaggtacgccatggcgctgagccagggtgagctggccggcaccgagcccaccctggagaagggcaccaacctgcagcacgccctgaaactggcggcccgccacctgcgccgccacccgggggccgaaccggtcgtcctggtcgtcaccgacggtgagcccaccgcgcacctggaggacgacggcgaggccctgttctggtggccgcccaccccggagaccgtccgggccacggtgcgggaggtcgatctgctcacccgctacggcgccacgctgaacgtgttcatgctcggcgacgacccgggcctgcagcgtttcatggacgcggtggcccggcgcaacggcggccgggtgttcagcccggacgccgaggaactgggccgctacgtgatcgacgactacgtcaacgcccgccggggccgccactgaggccttgacggcgccttcggtaagccgtaacttaccgttcgtggctacttaccaagcgcctgacgggtgggagatcctcggtgacccgagccggcgcgcgatcgtgtcctgcctggccgatgcgccgcgggcggtcggcgagctggctgatcgactgccgatcagccggcccgccgtgtcccagcacctcaaagtgctcaaagcggccggcctggtcgacgacgaggcggccggcacgcgccgggtctaccgtctgaacgcgaccggtgtggcggcactgcgggatcagctcgacgcgttctggaggcaggcactgcagggctatcagcaagccgtctcgtccgaagaggaaaccccatgacccggtccaccacgccgatcgtgctccggcagatcgtcgtccccgcctccgtgcagcgcgcgttcgccgtgttcacccaacggttcggcgatatcaaaccgcgcgatcacaatctgatgaccgcaccgatcaccgacaccgtcctggagccgcgggtcggcggccggatctacgaccgggccgcggacggtggcgagtgcacgtggggtcacgtgctggccttcgagccgccgcaccggctgctgttcagctgggacatcggaccgaactggcaggtggagcccgacccggccaaccgcagcgaggtggaggtccgcttcgtcgccgaggccgacgaccgcacccgggtcgagctcgaacaccgcaacctcgaccggcacgggcccggctgggagggcatccgcgacgcggtggacggcgacaacggctggccgctgtacctgcaccgcttcgtcacggcgctgggctagtcccgcagcgtctccgagggggccgtgccgtaacgctcccggtaggcggcggcgaaccggcccaggtgggtgaacccgaagcggtacgcctcctgggccaccgtcgtcgtccccggctccgcgccggccaggctgtcgtggaccaggccgagccgcagctggcgcagatacgtcatcggcggcatccccacatagcgcgcgaaactctgctgcagcgcccgcgaacccaccccggcgatccgtgccaggtccgccaccgtgaacggccgggcgggctgcgcgcgcatcgcctcgaccacccgccggatcgcgccgggcgcggccagcgccggggtctgccgctccagcgggtcccgataccggtgctcggtgctcagcagcagcccggtgaccagcgcctcccgcagccgggcaccgatcaccggatgcccggtcagcccgtccgggcagcccacgtcctcgacgatcagccgggccagccgggcccagccggcgcccggcccctgcgccgtgtcgagcaccggcgcgagctgcaccgggccgcgcactggacggtccagcaactgctccaggtgggtttccagctcggtccggctgatcttcacggccagcagccggcagtcaccgtcccaccggtccacgatggtgtcgccgaccggctggaacaccgccgcggaccgcccggcccacgcccggcgcggcgcgtcccggccctgatgccagctcaggccgccggtcagcgggagattcacgtggtaggcgccgagttccccggcactgacccgcacatccaccccgaaatccagatccccgagggtgaccgcggtgcagccgccgaccgcgaagcgcgccgtccagtcccgccgcttccgcagcacgtccatgtcgacggcgtagaagtacttgcgcaacacctcccgggcctcgccgacgtcgctgatctgatgagtcgaagcttgcacgctcaacagcttgaccggtcaattgaggcggtgccaatcagtgttaaatccgcctcctcctgactgatcgggcgatttgtcggggtcaaccggtgtacctggcggccggatgcccggtcagcagccccggtggcagccgccgcccgcagatcaccatcagcagatcctgggcccgcccgtgaaccgcctcaccggcaccgtgcgcccagtcacgatcggtcgccaccagccgcaccccgtcgagatccgccccgaaatacccgacactgcgcggcgacatcccacccagcaccagcgtcatccgcgctaccggcacctcccgccacggatcgatgtccagcgtgtggatgacatcgtgggacagcgcccccaccagtccacccccgggtggcgaccaggggtgctccacattgtcccgcaccgccgcgagcaacgcggcactgctcagccgcgccgcgtcccgccgggccacccgatccgccatccgatcgaaattcccgcccgcccgcgcgaaatccaccaggaaccgcggcagcgaagcccggaacggctgcgtcacatgcgccaccacctcccgcacccgccagccgtcacacagcgtctcccggtcccactgctccgcggtcaattccgccagcagcgcggcgagctcccgccgctgcgccgcgatctcggcccgcacgtcggtcaccgtcgtcatctccactcccttcgcgccctccgggcgcgcctcgtcgaaggggatacggcggcgggtccgctttttcatcggtccgccgattgccgcgtacgccgtcagccgcccacctgcacccacccctgcgccgcgccacccgcacgtggtgcgctgacccgccgcggccgggcggggcggcggggtggctatcttcggggatgtggaggaggtgctggcggggctgcgggtcgagctgaccggatactgctaccggatgctcggttccgggcacgaggccgaggacgctgtccaggagacgttcgagcgggcgttgcgcgccgccggccgctacgacgaggcgcgcggctcggtgcgcacctgggtgtaccgcatcgccaccaacgtctgcgtcgacctgctgcgcggagccgcccggcgcgccgtgccgctcgacctggccgcgcccggttccgcgggcgagccgttcggtgcgctgctggcgcccggtgcggaggtgcgcccgatccccgacgcgcgggttctcgacctcgcccaggacccggccacgctggtggtgcagcgggagagcatccggctggccttcgtcgccgccctgcagcacctgccgccccggcagcgctcggtcctgatcctgcgcgacgtcctgtgctggtccgccaacgacgtcgccgcgctgctggagagctcggccgcctcggtgaccagcgctctgcagcgcgcccgcgccacgctgcggacggtggccccacaccccggcgacccgctgaacccggccgacgccgaccagcgaaccctgctcgcccgctactgcgccgccttcgagagccacgacatcgccgccctggtcgccctgctgcacgaggacgccaccacctcgatgccaccgttcgcctggtccctgcacggtcgcgaccggatcggcctggctatgagcgcccccgaagccgcctgcaccggccaccgcctgctcccgacggccgcctccggacagccggccttctggcagatgcgcccgacagaggccggccacgtcccgttcgccctggtgatactcgacatcgccgaccaccgcgtggtcaacaccaccacatggctcgacaccaccggccggcacctgcccaccccgcccccttccctgtggtccctgttcaaccgccacccctgaccgcccgcccggtccgtcggtgcttgcaccggatcggtgagcggaggtaagggacgcggcactgccggctgcaggggagcggggtcgctgcaatgagggcgggaagcgcgccgccggctagtcacctagcctcctaggattccttagacggtgtggcgggcgtgactgggcgacgccgagcggtaggcaggtggttatagtgctcagcgaccgtgacacacacatcccggaagtccgggaggcgcggcgtcccgccgaatcaagcgcggcacagcgcgtcgtgaccgatttcggcatgccggatcggttggcgtaggggcgccgtatccgggccgcggcacagggggagaggaagtcgcgatgtcgtattcgtccatcgagacctccaatcggattttcacgattccgaatgtgatcagcttcatccggctgctcggggtgccgctcttcctctatctgctgctcggcccggagcgcgatgtcgccgcggtgatcgttctcgcggtcggcgggacgacggactgggtcgacggctatgtggcgcgccggatgaattcggtgtcccgtctcggcgagctgctcgacccgttcgcggatcggctgtacatcctggcgacgctgatcgggttcaccctgcgggaggtggtcccgtggtggctgaccggcgggctgctgctgcgtgaggtggttgtgggtgtggcgctgctgattctgcggcggcacggttacgggccgccgccggtgcactacgtcggcaagaccggcacgttcgtgctgctggccgcgttcccggtggtgctgctggccaaggcggtgccgtcgatcgactggtgggccggtccggtcggctggggcctggcctggtgggcgctgggcctgtactgggcggccggcgtgctctacctggtgcaggccgcgcggctgttgcgtgccgaccgggacggtcgggccgcggcccggacggtcacgccgtgaccgatccggcgatcccgggcggcgctctcccggagccggcgaagccggacgccgccccgcagcactccggcgcgcggcgaccgacacctacctcgcaggagtcgggcacgcggaagccgacacccgcctcgcaggatccacccgcgcggaggccgaacgcggcgacgcccgatcccgacggcacggcggccgggaagcggacctacggtcccgacttcctcaccgcgctgtttcagaatccgctcgatcccgggtatgccgacgccgccgcccgccgcgccgaggggcatgtccgcacgggtgcccgcaagcggctcaccgccggcttctccctgctgaccgtcggggtgatcggtttcctgctggtggtgggctatcagcagacggtcgccgacgagccgggccggacgcaggcgcgggatgcgctgatcaagcaggtggacagccggcgggagcagaccgagacgttgcagacccgggccgatgtgctcgccgagcaggtcgccaggttgcgggctcaggagctgggtggcgccgcggtggccgggatctcgaatctggaggcggcgaccgggctggccgcggtgcgcggctcgggtgcccgggtgcggctggcggacggccccacgtcggtggatgcggtgaccggtgagcgcagcacgctcgggcgggtcaaggacaccgatctgcagctggcggcgaacgcgttgtgggcggccggggcggaggcgatcgcgatcaacgggcagcggttgaccgcgacgtcgacgatccgccaggccggcgaggcgatcctggtggacacccggccggtgaccacgccgtacgaggtgatcgcgctgggcccggacagtctggtcgacaatttccgcaacgggtatgccgggaagttcttcccggcgctggcccagcagtacgggatgtcgttcgagacggagagggtccgcgacgtcacgctggacgccgctccggagctgaagctgcgggcggcgtcgccgagtacccctccgcccgctccgtcgggcagcccgtccgtggccggttccggtgtgccggctgtctctgcgtcggaaggcggccgatgatcgccgtactcgccctgctcgtcggtgttctgctgggcatcgtgttccatccgtcggtgccggcggagctggtgccgtatctgccgatcgcggtgatcgcggcgctggacgcggtgttcggcggattgcgggccaagctggacgggattttcgacgacaagcagttcgtcgtctcgttcatctcgaacgtgctggtctcggcgctgatcgtgtacgtcggtgaccagctcggggtcggcagtcagctgtcggtcggcgttgtggtggtgctcggcgtccggatcttcggtaacgtcgcggcgattcgccggcacctgttccgggcctaggtccggtgccgggccggctggggactacgtggggactcgatgaccgaccgtgaggacgacgggcgtgagctgacgccgccggggttcgacctgcccacggcggggcgcagaccgccgacggcacggccttcggccgctttcgacgagcttgcggggtacgccggtgaccccgccggggatgagcagacggtccgttacccggtggcgccgggcggcgatccggcgggcgacgctgccacccgggcgggtgacccggagacatcgcccacgtcacccgttccgtcgatgtccgacacgcccgagcctgctagtacagaaagtgatcttgatcgcctcagggagagcccgggagaggacccgagagagagcccgggcgaggaccggggagacgtgcggtcgggcccgggggagagcgcggacggcggcgagcggccgcccggccggggtggtctcaagcgaccggcgcccgccggcaccctgatctgggtcctgctcgccctgctcggcttcaccctggtcgtgcagttgcgcagcaacgacgcggacagtggcctgtccaccgcccgccaggaggacctggtccagatcctgagtgacctggaggcccgggacagccggctgaacagcgacatcgaggccctggagcgcagccgccagcagctcacctcgggtgtcgccggccgggaggcggccctggacgaggcgaacaagcgcagccaggagctgggcctgctggccggcacgattcccggccgcggccccggtctggagatcgtgctggaccgggtgaaggcttcggacgtgctgaacacggtgcaggagctgcgcggttcgggcggcgaggtgatgcagatcagcgggtccggcgggaccccggtgcggatcgtggcgtccacctatttcatcgacgccaccggtggtggcatcatcgcggacggtgaccggttgaccgggccgttccggctgctggtgatcggtctgccggagacgatgaggacggcgctgcagatcccgggcggggtggtggcgtcggtgaagagcgacggcggtagcgtgaccatggactcgcgcagcatggtcgaggtgaccgcggtgcgtaaggcggctgcattgcagtacgcccgtccggtttcgtgagctacggaggaagtgttgattcctgagaatctgcggtacaccgcggagcacgagtgggtgtccggcgacggcaccggccccgtgcgggtggggatcacccacttcgcgcaggatgcgctgggtgacatcgtcttcgtgcagctgcccgaggagggcaccgagctgcaggccggcgactcgatgggcgaggtcgagtcgaccaagagcgtctcggagatctacgccccgatcgccggcaccgtggtggcccgcaacgacacgctgggcgacgagcccgagctgatcaacgcggagccgtacgcggcgggctggctcgtggagatcgccccggccgacccggccgcggtggacgcgctgctcgacgccgcggcgtaccaggcgctgaccgagagctagaacgctcggtcagaccgtaagcatcgacccgcgagtctggttgccccgccataatggcgctgactaggctcgcggggcacatgtagaactgttatcccgtggcaatgtcctactaaaccaagatagtcgtgcgtcgggccttaaggcctcggcgaggccgccccccgtggtggcccgccggtcgaggcgacgaccaactgatccgtgaggtggtccgatgacgcgcccagacgacgagttccccccactcgacgtcacgtccacgctgaacctcggcgccctcgacgaggtgctcgagggtcccgagaccgacgtggtgcccagccggatgtccggctcgctgccgcccggcatggcgctgctggtggtccgccgcgggccgaacgccggcgcccggttcctgctggatcatgacgtgaccaccagcggacggcacccggacagtgacatcttcctggacgacgtgacggtttcccgccgccacgccgagttccaccgtgacgggggcgtgttcaccgtgcgcgacgtgggctcgctcaacgggacgtatgtgaaccgtgagcgggtcgaggcggcgacgctgagcaacggcgacgaggtccagatcggcaagttccgtctggtgttcatcgccggcccgcggccggagggcgagggcggccgggcgtgacttcgtcgggggcggccgcgcgcgacccgggggccgagcgtccccagggcgggcgcgagggtgcgctgatgagcatcggggaggtgctggcccatctgcgcaccgagttccccgacaccacgatctcgaagttgcggttcctggaggcggagggtctggtcgacccgcaacgcaccgcctccgggtaccgcaagtactcgtggaacgacgtggcccggctgcggttcgtgctgaccgcccagcgtgatcagtatcttccgctgcgggtgatccgcgagcagctggaccggatggagcaggagccggtggtgccccagcgcccgacgctggtcgcggtcggcgcgcagcgggccaccgatccggccgacgcccggattccgaaggacgatctggtcgagcggaccggggtcgacgaggcgatgctggccgagctggagcagatcggtctggtcgtggcgcgcccgccgggctggtacgacgcggatgcagtgatcatcgtcgaagccgtggtgggcctcacccacttcggtctggagccccgccacctgcgggccttcaagaacgcggccgatcgtgaggtcggcctgttcacccagttgctggcgccgctggcccggcagcaggacccggcggcccgggcccgggccaccgataccgcgcgtgagctgcaggctctctcgcagcggttgcacgcggcgctggtgcgcaccggactgcgcggcgaactgggtcgctgacccctgttcggcctaccctgggcggggtatgccgcgcacggcagatcggctcgccgtgcgtgtaccgtgcaggataaggggcagccgtgcggtgcgggacggcgacaacaacgaacacggaggcggtgcggtgcgcgagctgagcgtggtcggggttcgggtggagctgcccagtaaccagccgatcgttctgctgcgagaggtcgacggcgaccggtatctgccgatctggatcggcgcggtggaggcgacggcgatcgcctacgagcagcagggtgtgaaaccggctcggccgctcacccacgacctgctgcgcgacatcctggcggcgctgcagcagccgctgaaggctgtcgagatcaccgagctgaaagacaacgtcttctacgccgatctgctgatcggggagaatctgcgggtctccgcccggcccagcgactcgatcgcgctggccctgcgggtgggcgcgccgatccggtgcgccgaccaggtgctgaccgaggccggcatcgtcatccccgacgagcaggaggacgaggtggagaaattccgcgagttcctcgaccaggtccgcccggaggacttcgcgggctgaccgcgcccgccggccgccggaaaagtcgggcaggtcgccggaaaacatccggacgcgccggagagtgacggggcttcggcgtgtcgctcgtccgaacgcggcgtgtcgtgccgttacctccatgtttcgactgcggctgagatatacgctcgtgaagtccaggtgaaccggcaccgcccagatacgttgatcatgggcagcggggaggtagtcgcgtgcacgagcagcctctggagggccccctcgtcggcgaggacggcgaggtcggctatcgcggtgtgacggcctgtcaggcggtcggcatcagctaccgccagctcgactactgggcgcgcaccaccctggtggtgccgagcgtgcgggacgcctccggctccggcacctcccgcctctactccttccgtgacctggtggtgctcaaggtcgtcaagcgcctgctggacgccggggtgtcgctgcagaacatccggcgcgcgatcgacacgctccgctcgcacggggtggacgacctggccgggatcacgctgatctcggacggcaccacggtgtatgagtgtcgctccccggaggaggtcgtcgacctgttgcagggcggccagggcgtgttcggcatcgcgatcggcggagcgttcaaggagatccagggttcgctgtcgcacctgcccgccgagccggccgtgccgcagccggtgggtcaggtccccgaggagccggcggcaggtgacgagctcgccgcccgcagggcccgccgccgtgctggctgatccgcagcggcacgagttcatccaggtccgcggagcgcgggagaacaatctccgcgatgtctcgctggacctgccgaaacatcagctcaccgtgttcaccggggtgtccgggtcgggtaagagttcgctggtcttcggcaccatcgcggccgagtcgcagcggttgatcaacgagacctacccggcgttcctgcagtcgttcatgggcagtccggcgcgtccggacgtggacgcgctgcacaacctgagcgcggcgatcgtcgtcgatcaggagcggatgggggcgaacgcgcggtcgacgctcggcacggtgaccgacgcgtacaccatgttgcgcatcctgttctcccggctcggtgagccgggcgcgggcagcgcgctggcgtactcgttcaacgccgaggggatgtgcccgcggtgtgagggtctgggccgggtgtcgagcatcgacgtcgacgggctggtcgaccgggacaggtcgatcaaccagggtgcgatcaccgtgccgaacttcagcgtcggcgggtggtacgtgcgcgggttcgccgagtccgggctggtcgacccggacaagccgctgcgcgagttcaccgagcaggagtgggccgacttcctgcacaagccgccggtgaagatgcgcatcggtggggtgaacacgacgtacgaaggcctggtcctgaaggtccagaggatgtatctggccaaggagcgcgaatcggcgcagccgcacatccgcgcgttcatcgatcgggtcgccaccttcaccacctgcccggagtgcgccggcgcccggctgaaaccggcggccctggcctcgcggatcgccggccggaacatcgccgagtgctccgcgatgcaggtcagcgacctggccgggttcctgaccgaggtcaccgacccggctgtcgcgccggtggtgcgcggcctgcggcacaccctggagtcgctggtcgagatcggcctgggctacctgtcgctggaccgcgagtcgggcaccctgtccggcggggaggcgcagcgggtcaagatggtccgccacctcgggtcgtcgctgaccgacgtcacctacgtgttcgacgaaccgaccgtcggtctgcacccgcacgacatccagcggatgaacgggctgctgctgcggctgcgggacaagggcaacacggtgctggtggtggagcacaagccggagaccatcaggatcgccgaccacgtggtcgatctcggtcccggcgccggcccggacggtggacgcgtccaatatcaggggccggtggcggggctgcccgggtcgggcaccctgaccgggcgcttcctgggccatcgggcagccctgaagaaggcctgtcgggaaaagacgggcaccatcgccatccggggcgccagccggaacaatctgcgcgacgtcgacgtcgacctgccgtccggcgtgctcaccgtggtcaccggcgtggccggctccgggaagagctcactgatctacggttcgctgccgcggcgcgacggcgtggtcgtcgtcgaccagaccgcgatccgcggctcccggcgcagcaacccggccacctacaccggtctgctcgacgcggtccgcagcgccttcgccaaggccaaccgggtgaaaccggccctgttcagcgccaactccgagggcgcctgcccgaactgcaagggcatcggcctggtgtacctggatctggcgatgatggccggcgtcgccggcgtctgcgaggagtgcgagggacgccggttcaccgcccgggtcctggagtaccggttgcgcggccgggacatcagcgaggtcctcgccatgccggtcagcgaggccctggagttcttcaccgagaaaccggcgcgggcgatcctggaccggctgtccgcggtcggcctcggctacgtgaccctcgggcagccgctgaacaccctgtccggcggtgagcggcagcggctcaaactggccgtgcacatgggcggcggcccggccacctacctgctcgacgagccgaccagcggcctgcacctggccgacgtcgaccagctgctggccctgctggatcggctggtcgacgccgggaacacggtggtggtgatcgaacaccacctggccgtgatggcgcacgccgactggatcgtcgacctgggtccgggtgccggtcaggacggcgggcgtgtggtgttcaccggtaccccgcacgagctggtcgccgacgcctcgacgctcaccgcccggcaccttcgggagtacgtgggctgagcacggtcttctcggcccgcggcgtgatggtgcgctccacgttgatcgcgtgccagaggcagaacatggcgaccgtccacaccttgcgggaccggtcggcgaccccggcccggtgctcggccagcagcccgcgggcgtactccaggtcgagcagatgcccggtctgcgaggtggccagcagctggtcgacccagtcgccgatcacgccgcgcagccacagccgggtcggggtggggaagcccagcttcgcccggtcccgcaccgactcggggacgatcccgcgcatcgcctcgcgcagtgcgtgcttggtggtgcgcgacccggccggcagtttcagctcggtggccagcccggccgcggccgcgtacacctgctggtccaggaacggcacccgcagctccaggctgtgcgccatcgacatccggtccgccttgaccaggatgtcgccgggcagccaggtgtgcagatccacgtactgcatggaggccacctcgtccacgtcggcggtctcggcgtacaaccgcgcggtgatctcggtgtgcggcgccgaggtgaagcgcatcagccgggccttctcctccggatcgaagatccgggcgttgccgtagtagcgctgctcgatcggcgtggtgccccgctccaagaaggagcggcccttgacgccctcgggcagcacgtgcgccagatggtgcaggccgcgcttgagactgggcggcagcttgtcgacggtggccagcgagagcggctcgcgatagatggtgtacccgccgaacagctcgtcggcgccctccccggagagcaccacggtgacgtaccggctggcggtgcgggccaggaagtacagcgggatcagcgacggatcggcgaccgggtcgtcgagcagctgcacgatccgcggcagctcggccagcacctgctcgtcgctgaccaccgtcggggtcagcgggatgcccagctggttcgcggtgtcctgggcgacgtcgatctcggagtagccgtcggcggcgaacccggcggtgaacgcgtggatgcccggctgtgcctcggcggccagcgcggcgaccgcggacgagtcgacaccgctggacaggaacgtgccgaccgggacgtcggcgtgcaggtgggcgcggacactggcgcgcagcgcgtcctggatctgccggtgtgcggccgccggctgcaggcgcagcggccgcagcgacgggcggaaccagcggtgctcgcggaccccgccgccgggcgtccacaccagccggtgacccggcggcagccggcggatgtgccggtgcaggctgagcgggtccggcacgtactggaaggtcaggtagtgcccgagcgcgtcgttgttgagcgcggcgccggccggggcggcgaacgggtcgagggctttgcgttcgctggccagcgacaacccgtccgcggtctccagcagatacagcggcttgaccccgaacgcgtcgcgggccgcgtgcacggtgccggtccgggtgtcgtaggcgacgaacgcgaacatgccgcgtagccggggcagcgccgcctcaccccagtagtggaacgcggcggccagcacctccgagtcaccctcggtggcgaacgtcgcgccgtgcgcgctgatcagctcggcccgcagctcccggtagttgtagatctccccgttgaacaccaccagccagcggtcggcgtagtacagcggctgcaccgagtggtcccggtcgatgatcgccagccggttgaagccgaggatgtacccgtcgccgtaggccagctgcgagtcgtccggcccccggtgccgcatgctctccagcgccgcggtgaacgccgccacggtcgcctggtccaccggcccggcctccggcctgctgctgaaaaacgcgctaagaccacacatgccggggaccgtagaaccggcttgtgaaaatcctgtgcggttcctgcgggcttccgttcccgcaccggatctcctacgacttcctcatcggttctccacatttcccaggatcacgctcttcacgtgcagtgaccagtcgaggtcctcacccccggtctcctgccggatggtgagcgcctcctcgatcgccgccagcgccggctcggcctcgccgagcacgatgtggcgcaccgcgaggtcggtcagcgcggccgccagactgggccggaacgcgtccggccgccggtcggccagatgccggcggatcgtcaccgcgtcggcggccgcggcccggctcgcctcatcctcgtcgaggctgcccaggttgatcgccaggatgctcagcgccgccgccagctcgggcaggaacaccccgggttgctcgacggcgagcacccggtaaccggcgactgactcctggatcgcggtcagcgcctgcgcgaacatctccaggccgccgaacgccagcgccaggttccgggccgagcgggccagatcggcccggtacgactccggctcgcgatcggtcagccgctggtagagctcggtggcctcggcgatcgcggaaagcgccggctccggctggccgactgcgccgagccggaccgacaggctggtcagcgaccgcgccagatccgcctcgtacagctccggctgctgcccggccagccggcggtggatgaccgcggcctcctcgatcgcggccagcgccggaccgtcgcggccgaggtcgccgagccggatcgacaggttgctcagcgccagcgccagccccgcctcgtcaccggcccgccggtgccgctcggcgatcgactgggccacctcggccgccagcggggacagccggggcaggccctcggcgatccgggtgagccggtccaccggggtgtccgggtcggcgctgatccggaccagagcggccagcagcggctccggctcgtcggcggcggcggccaccgtcagcacggccggggtgagccggtcggcgtgccggacacacagctcggtcaaccccggatgccgggcggcggccagcacgctcaacacccgctccggggcgtcctcgacgaggatctcggcgagtgccgggcgcgcggccaggcgcagcgcgcagaaccgctcggcgagcggatgaccggcggtgtccagatcggcgagccaggcgccgaccgcgtcccggtgctcaccggccagccggtccagcagacggtcggtgggctcggtgagcatcgcggcggccagcacgtcgtgcaggatccgttcgtcgacggccaggccgtgccaggccgcggtgaacgaccagacccggctctcgtgcacgagcagccggtcggcggccgaccggccggtcggtgccgggccgaactgggcggcgtccagcaggtcggccagcgcctccatctggacggtcagcgcgtgaccgccggcgtcgcgcggggtggcggcgagccgggcggcgatcgccgaccacaggtggccaccctggccgggcacccgggggagcgcggcgcccagatcgcggaccgcctcggcgtacgcctcccggcggccggccgggtcgtcgtccagttcggcaagctcggcggtggtcgcccccgccagcagcgggtcggtgcgcagccgctgccaccaggggccgtcggagcgggcgagcagcagcagccgcagcgggcggtcgccgtcgtgggcggcgcacgcggtgagcagcccggcgatctgctcggggcgggtctcggcccggtcggcgacgatcagcgtcgggacggtgccgtccgggacggggcggtcaccgtcgctgagccggtgcaccccccagccgaccgcggccaggcgggcggccagccggccggccacccgggtcttgccctgcccggccgggccgtgcagcagcagcgccgcgaaaccggcgccggaacaccaggcgcccagctcgtcgagcagtcggtggcggccgcggaacgcgaccacctcggcctcggggcgcagcagggcggcggggaagcgcggccgcaccggtgcctgcgcctcactgagatcgatctccacccgctcacttttccatgccggggtacctgcccgcacccaccgcacgggggaggtgtcagagcgacttcttcgcgggccgccgcgcctcgtgccgggtcacccgggtgcgcgggccgcgctggcgcggcgcggcaaccggccgggcctcggcgtgcgggaagacgaatcgcttgaacgcccacagccggaacaccatcgcgatgagcgtgcccaggatgatgccgctgacgaagtcggcgatctcctgcaccggccggctgacgtccggcacccgcagctccagcacgtaccgcgagacggccagcgggatcaggttgaggccgatgccgatcgcgctgaccgcgaagaacagggccgcctcgtgatgctgctcacgcccgccgcgggtgcggaacgaccactcgcgattcagcacatacgacaggatggtggcgaccacggtcgcgaacgccagcgcggtgaccggcttgtcgtgcagcacggtcagtttcagcagatagttgaccgcggtggtggccacgaagcagatgccgccgaccatgaagaacttggccgcctcgtgatgcttcgcccacaaccgcctcagccacatccgggcaagtttgtcaggcattttccggaccggcaacttcgcgtggcagggtgggccggtgaacgcgaacccggtgagcaccgacacggtccgtgacctgttgacgcgacagtttccgcagtggagtcggctgccgatcgagcggatcggagcgcacggcaccgtcaacaccgtctttcgcctcggcgatcacctcaccgcccggttcccgcgccacgacaccgaggatctgctcgccgaggcgcgggcggcacgggaactgctcggcgtcacccggttcgccactccgcaaccgctggcgatcggcgagccgggtcccgggttcccccgccggtgggccgtccagacctggctgcccggcactgtggccagcgagaattcacattcaacggcgatcagtctggggtacgacctggccgagctggtccagggtgtccgcggcatggacacccgtggacgcccgttccggggccgtggccgcggcggcgacctgcgcgcccatgacgactggatggccgagtgtttccggcagagcgagccgatgctcgacgtcggcccgctgcgcgccctgtgggccgagttgcgcgagctgccccgcgagtcgccggatgtgatgacccacggcgacctgatccccggcaacctgctcaccgagggtgaccggctgatcggggtgctcgacgtcgggatgctcgggccggccgacccggcgctcgacctgatctgcgggtggcacctgttcgacgacccggtacgggaggcgtggcgcaccgcggtgggcggcaccggtctggactgggcgcgcggccgggcttgggcgttcgtccaggcgatgggcctggtctggtactacgtcgagaccaacccggtgatggccggcctcggccggagcactctgcgccgggtcgcttagcggccgccgtcagcgcatctcggccggcagccggacggtgaaggtggtgcccagcccgggttcgctggccgcgctgatgttgccgccgtggtcgtcgacgatccgccgggcgatggtcagccccagcccggaaccgccggtggtccgctgccgggccgggtcggcccgccagaaccggtcgaacacccgggacacctcggccgcggtcatccccaccccggtgtcggccaccgtcaggatcgcggtgagcgggtcccggctgaccccgacctcgacccggccgccggcgtcggtgtagcggatcgcgttgctcagcaggttgccgagcacctgccggatccggtccgggtcggcggtcaccagcaccggttcgggcgcgtccaggatcagttccaggccggcgttcgcggcgttcgcccggtgcgcggtcaccgacgtctcggccagctcggtcagatccagcggctccggatggtaggccaggtcaccggcctcggccagggcgagcatctgcaggtcgtcgaggatccggcgctgcagcagggtctcctcgtgcagcgaggcgaacagttccggggtcggttcgatcacgccgtcggccaggccctccaggtacccgcgcaggttcgacaacggcgtacgcagctcatgggcgacgtcggcgaccagccgccgctggcgctcctcgctgcgctgcaccgcctcggccatcgcgttgaacgaggcggacaggaaggcgagctcgtccttgccgccggccggcacccgcacgtccagctgcccggcggccagctgcagcgacgccccggtcagcgcccgcaccggccggctcacccggcgggccacccaggcggtgccgagcgccgcggcgaccagcagcccggccgcgccgaacaccgccggtcggcccagaccctgcagatcctgggcgcggccggcgccgaagtagaccttcaccgggatgcccgacgtgctcgacgcgccctgcgcgaacgccggctccaggcactggtcgaagtaccgcgggtcggagcggcactggacgaactgctgccaccactcgtcgagccagccggtgtcggcgaacacccggttgcgcccggcccgcacgcagtcggccgccgtggtcaactgctccggggtcaggaacggcagctgctcggtgcccagctgcggcagggtcagctcgtgccgctcggccgcgcagcggaccgcgaccagcccggcccggtactgcgcgagctgcagcagcgccttgccctccggggtggtcagcccgctggttcgcggcgtgaccgtgaacaggccggcgggcagcgccggccgctgtcgcatcatcgcctccacctgcgaccggttcaggcgtttcaggtccgaggtggtgatcacgttcgggtcggcccgggccgcctgggcgatcgtcaccgcgtccgcctgggtgtccgggtccagacccgggaacggctcgatcgagatcggctgcagctgcaccgggccgaccgcctgcccgcggatcacgtcggagtcggccagcgtgatgtccgcgccctccacccggatgtgcaggccggtgcgccgggacagttgcgcgaccaccgcgtcgatgccggtccactgcccgttggtcagcccgaaccggcggatcgcggtggtgatctccaccttgtgccggtcccgggcggcgttgagccgggacagctcccgcgaggtgaggctgagcgtgagccaggcggtcgccccgatcgcggtgccggccaccaccagcaccagcaggaagatccgtagccggaaactcaccggtcgcccatccggtagccgcgcccgtacaccgtctgcacgtaccgcggctcggccggattctcctcgatcttgcgccgcaggttgaccacatgcgcgtcgacggtccgctccgacacgtcgttctcgaacccgaacgtcttgtcgatgatctgcccccgggtgaacacccgccccggctcccgggccagcagttccaggatggcgaactccttggcggtcagccggaccgtcgccccggccacccgcacctcgaaccggggcgcgtccacctccaggtcaccgacccgcagcacctcgcggttctccccgccacgcacccggcgcagcagcgcccggacccgcgcggtcagctcccgcgggctgaccggtttgctcaggtagtcgtccgccccgatgtcgagccccagcagcatgtcactctccgccgaccgggcggtgaccagcaggatcgccaccgagctcagcgccgggtccgattcggcccgcaggatccggcacacgtccagcccgtccaccagcggcatcatcacgtccagcaccagcaggtcgggccgccgcgcccgggtctgctccaaggccgcccggccgtcgcccacagtgagcacctggtgtccatcccgctccagatagagccggatgagctgggcatgcttcggatcgtcgtcagctaccaggatgcgggcggtcacggctggcattcttacccggcgtgtccacccccctcaataaatatgcgaatcctgtgaagccgtccggtagaccggatcatgccgattgcggtagtagagccgcacctccacactcgcgtccggctcaccgaccgcccgcagttgcaggcagaggtcgtacgggtcggccagccggtgcgacccccggcagtcgacgtcgggctcggcgaaccccggataccaccgcatccgccacccgtccgccatcgccagatggttcccgatccgccgcgccagcccccgagcctctccggtccccgccgcccgcaccgtgatcacccgggtgcaccgcgcccggttgcagtccagccgattcccggccgccaccacaccgtcgggcagactcaccaccccatccggcagcaccgcccccggcggcaccggcggttgccccaccaccggcaccgcgagaatcaccgccacccccgaaacccacaccaccccaccgaccagccgtacgccgccccacccgccgccgcggctccaggccgcgcccgccagcaccgtcaggccggccgcgaccagatgccaccgcaggaagtcgtccacactgggcggcgtctcgtaagtccccgccgagaccgtcgccaccgaccatcccgcgaccagcgccaccaggatcagcccgacccggcgtcccaccgtccgcccccgggccagcaccgcccaggacaccggaaagatcagcaccaccgccaccagcagcgccactccggcgatcgccggcatccggtccgcgaccgggctccccgacggcaccaaccgccaggccggacccgtagccaccagagtgatccccagaaacagcagccgttcccggccaccccaagaccgttccatccctctgtgacgagcccccgccacgctcggttccccacccatcgtccgcccggcaacctggcacactcgccgcccggccttgcctgcccagcccggccgccctgctcggcacggcccggcccggatcgctattggctccccggcggcccgtacgattgcgggtcgggcgatcggagagaaccacggcatggaacgagcgttcgtcctcctcaaaccggactgcctgcgcacgggccggagttccgccgtcgagtccgtcatcaccgccgagggcctgcgtatcgcctgccgccaccccctcaccctgaccccggccgacacccgcctcctctggtcggagtacaccgacgaaggccacgttctgatgcgcgccctcctcgaccgctatctgtgcacggccccttccgccgccctcctgctcaccggcccgaacgccttcgaagccgcccgccgcgtcaaacgcaccatccgctcccgctacgccaacggccccttcgccaacctcgtccacaccgccgaaaccccggctgagctggcccgccaagccacccacctcttctcccgccccgacctaccgcccgtcgaccacctcgggtacacccactcagcccccagcgacgccgcctcacaccgccccaccgatggccgaccacctgtccgtcacccggcacccgccggtggtccgccgcccgtcgatgggccggcgcctgtcggtggtccgccgcgcgtcgatgggccggcgcctgtcggtggtctgctgcgcgtcgatgggccggcgcctgtcggtggtctgctgcgcgtcggtggtccggcccccgccacatgctccggagagtgcgcacccccgttcctttcctccgacgcgtccccgaacgctccccgacccaccggccgcgacttccgtcaggacgccgacatccccgcactggtcaccgacctctggcccctgctgcaggccaccgacccgccgccgcccccgccgtatcacctggacgaccacgcccagcccacgcaccccgcgacgcgcgacgatgcggccctctacctcggcgcggaccgcgcacattccctggactcggccgtcaccgccatctggtcggcgttacccggtatcaccctcccgcgcgcactcaccctgatgctgtacgccagccgcgtcgacggttacccgatagccataggcagccaccacgccatcgcccagagccaccgcatcctcttgcagcaccagctcacggcctgcggcatcggcccgatacaccagcgctgggcgtcgccgatcgccgatcaaccggcgaagaaacagtgatcatcgaactccgttgcgcagcacgcgttattgcggcccaccctcgcgcaccttgaaaaattgacaaggtgcttcaggtggaccacgcaggctcgcagaaaaacttcttcccctgcgacagtattcgcctttatcagcctgtatcaccgcccggtgaccacgacgatcccggcgccagctcgcctgtccgagtgtcaccttgaccaccatcaaacaccggcccaccaaaacaataaaaataccaccctgatcccgctccgccgcaagcagagaatcaacagttttagttgttctcgacccgttaactgcaaccttttcctcgctcgccgccccggggcggaccggttcgtcggccgcaatcttcagcggggccggtccgtcggccggaatcttctgccgggcaagttccacggccgccgcctgtgacaaagccggttcgtcggccgccgcctgtgacaaagccggttcgtcggccgccgcctgtgacaaagccggttcgtcggtcgtcgcctgtggcggggccggttccccggccgccacctgcagcaggaccggttccccggccgccacctgcagcaggaccggttccccggccgccacctgcagcggagtctgctcttcaaccgccgcagcggagaccggcctccggtgaggccccggcgcaggagccggacccgccgatggtgaccgtcctgaaatcgcctgccgccgccgttcatccgcagcgacaacggccgcccaagcctccgaagccctccatccgttccgcaccaacttccgcgtgtgcctctgccgcagaccccattcacgacgacgctcatgatcacgtcggaattgctctttctccgccgaataaccccgtgccgcggtgcggtcccgcatccgcgcgacctccgaccgaccaaacagcgataactgccccaccccaaaattatcccggccccgaaaacaaagtgtaagccccgtcaagtgccaaaaaaagatattcccgccaagccgcaccgaaccgccgatgaaagctgggccccgacactcatcacatgccgcgctaccgcaccgctcacctggcgcgatcccgttggcctatcccgcactcgggcaggggagctctgccaggagggggtcggcttcccgcatagcagttctccgtcgaggctccggctagggaccacgaacggtctcctgccggagagtgccgggctgcaggaactgtggatcccaaggccgcgtgccgcgtggcctgcgtgctgcgtggcctgcgtgctgcgtggcctgcgtgctgcgtggcctgcgtgctgcgtggcccgcgtgctgcgcggcccccgagctgcgtagaccatgggatcacgaggacggcggcctacgcggagcgcaagccaccaggagcgcgcagagcaacctgtcagtgcgcagtccgccacaccgcggagttcccaccgcccgcctgtcccgccagcgccgcccccgcagcgttcgcgccgccgaccaccggcagcccgccggccggaaccgacatgccgagatgcagcgtgctcccggtgggtgcggtggcgaccggcagcaccgggtaggcgttgcccccggcgacgacggacgtcgagatgtagtcgccgaacatccgaccctgggaggtgttcgggatccaggacaggttcatcggcccggccaccgcggtcgcgccgctccatgacgtgccgccgttgaccgaggagatgaagccgacgtcgagctggcacgtcgacgccgtgcaggacgagtccggatagtagtagtaggagagtccgatgcgcgcggatgcgccggacgtcgacgggtcgaccccgatgccgggcacgaaatgttccaccgtgctgctggtcgcgtcgatcggcacccgcaccggcgcggcccaggtggtctcgctcgtcgacttggcgatgacgatgtcgttgcgggggcagccgctgcggaaccggcagtccgaccagctgacgtacacggtgccggcggcgtcggcctcggcgctgggcagaggctcctcgcgcaggccgccggccacgtcgtggtggctgacggtggcgacggcgacggtcgagttccacgagctgccgccgttggtgctgcggaatgagcggatggtgtcggtggtcgacaggtacggcacgatgacgtcgccgttgcgcagcacgaccggctgtccgccgaggccggcgtggctgcctccgggggccagtgccgagccccaggtggcaccgccgtcggtggacgtcttcattctgatggagtcgccggagctggtgacgtcgtactcggtgtagcagttgccgtagtgcgggctggccgcggtgttgtcgcagacgatccagttcttgtccagtgagccggttgccgtgatgaccgggttcgaccaggtcagcccgccgtcggtggaccggctggtgagcacgtcgacggtggagccgccgaggcgtcgaaggccaccgaggcgtcactggcctgcccgaacgtaccgccgccgctggtggtgacgcccggcaggaagccgtgggtccaggtcgtgccgccgtcgccggaccgggcccagccgatgttcgacgcgccgccgccggagacccggccgacctggaaggccgacacgatggtggatccgaaagcataggtgtccggctccacctcactctgatgttgtgcctgggtgtcggtgtacggatcggtgctgacctgggtgagcgcggcgttggccgctgccggcgccgcgggccacagcagcagggccgcggcggcgggaagggccagcgcactcagcagggtggtacgtggatgcacggtgacaccgcctcgtcgagttccggacggtggccggcggggatggcggccaccgcacccgtgctaccggagccccgaggcgttgtaaatagagaattgtagatatgtgcgggatccgcgccacgccgtccgggggagtgccgagcgcctccacggacgcggtcgtggcgtgacgggtaaagtctgcgggcatgtatcgcccggttccggcccaggtcgacctgcccaccctcgatcacgaggtgctccgcttctggcaggagcggaacgtcttcgcggagagcctgcggcagtccgcgggtcgtcccgagtgggtgttctacgagggcccgccgaccgcgaacgggatgcccggcgcgcaccacatcgaggcgcgggtgttcaaggacgtgttcccgcgctaccggacgatgaagggtttccacgtcgcccgcaaggccggctgggactgtcacggcctgccggtcgagctcgccgtggagaaggagctcggtttcagcggcaagcaggacatcgaggcgtacgggatcgccgcgttcaacgaccggtgccgcgagtcggtgacccggcacaccgacgccttcgccgccctcacccggcggatgggctactgggtcgacatggacgacgcgtaccggaccatggacccggcgtacatcgactcggtctggtggtcactcaagcagatcttcgacaagggtctgctggtcgaggatttccgcgtcgccccgtggtgtccgcgggaccagacgacgctctccgaccacgagctggaccaggggtacgagatcgacgtcgacccgtcggtctacgtgcgtttcccgctcacctcgggcccgctggccgggacgacgtcgctgctggtctggacgaccacgccgtggaccctggtgtcgaacacggcggtcgcggtgcacccgtcggtcacctacgtggtggtcaccgacggtagggagcggttgatcgtcgccgagccgctgatcccggagggtctcaccccgaccggcgagtcattcctcggcaaggaactggagcgctggacctatcagcccccgttcgcgatggtcgacgtgccggacgcgcacatcgtgatcctggcgaactacgtgaccaccgacagcggcaccgggctggtccaccagtccccggcgttcggcgctgacgacctggccagctgccgcgcctacggtctgccgatggtcaatccggtgcgccgggacggcaccttcgagccggagatcgaactggtcggcggcatgttcttccgggaggcgaacgggccgctcgtcgaggagctgcggaccagcggccggctgttccggcatgagccgtacgagcacaagtatccgcactgctggcggtgccacaccgcgctgatctactacgcgcagccgtcctggtacgtccggaccaccgcggtgcgggacgcgctgttgcgggagaacgagaagacgaactggcaaccggccaacatcaagcacggtcggtacggggactggctcgtcaacaacgtcgactgggcgctgtcccggaaccgctactggggtacgccgttgcccatctggcggtgcgcggcgggccacctgacgtgcatcggctcgcgagccgagctgtcccacctgaccaaccgtgatctgtccgacctggatccgcatcggccgttcatcgacgagatcacattcgcctgcccgcagtgcgaggcggaatcggtccgggtcccggaggtcatcgacgcctggtacgactcggggtcgatgccgttcgcccagttcggctatccgtaccagaacgccgaactgttcgagcgccgcttcccggcccagttcatctccgaggccatcgaccagacccgcggctggttctacaccctgatggcggtcagcacgctcgtcttcgaccgctcgtcctacgagaacgtggtctgtctcggccacatcctcgccgaggacggccgcaagatgtccaagcacctcggcaacatcctggagccgatcccgctgatggatcagcacggcgccgacgcggtccgctggtacatggcggccgtcggctcaccgtggtcggctcgccgggtcggtcactccgggctgcaggaggtggtccgcaagaccctgctgacgtactggaacacggtcgctttccaggcgctctacggccgtaccgcccagtggacgccgtccgcggcggacccggagcccgcgcagcggtccgcccttgatcgttgggttctctccgagttgcagcagctcatcgcgaaggtcgacagcgcgatggcggcgttcgacccgcacgagacgggcaaactgatcgccgccttcatcgacgatctttccaattggtacgtacgccgtagccgccgccgtttctggcgaggcgaccccgccgccctcgccaccctccacgaagcgctacgcgccgtgaccctgctgatggcgccgatcaccccgttcgtcaccgagcgggtgtggcaggacctgatcgtcgcggtcgatccgcaggcgccgtcctcggtgcacctcgcggcgttcccggagccggacaccgccctggtcgaccacgatctgtccgcgcagatggcgaccacccggcggctggtcgagctgggtcgcaccgcccgcgccgaatccggcctcaagatccggcagccgctgtcgcgggccctggtgtccggcggcgccgacctgccgcccgagctgctttccgagatcgccgccgagctcaacgtcaacgcggtcgaggcgctcgccggttcgttcgtcgacaccaccgcgaaggcgaacttccgcgccctgggccggcgcttcggcaaggccgtccagcaggtcgcggcggtcatccaggccgctgacgcggcacgactgaaggacgatctgcggacgaagggatccgcgaccgtcacggtcgacggggaagaggtcacgctcgccccggacgaggtggtgatcaccgagacgccgcgggagggctgggcggtcgcctcggacgccggcgccaccctcgcgctcgacctgcacctgaccccggagctgcgccgggccggtgtggcccgggacgcgatccggcagatccaggaggcccgcaagggcagcggcctggaggtctccgaccggatccggctgcgctaccgggctggcggggacacgtcgctggccctggccgagcaccgcgacctggtcgccgacgaggtgctggccaccgacttcgcggccggcgacccggactgggccgatccgcgggagttcagcgacgactcgatcggcctgaccttctggatcacccgctcgtaggggcgcctactggaacaccaccgtccaggcggccgggtgcgagatcgctccggtcgccgcgtggatcaccatggccgtgtcgccggggcagccgaccgagctgaggtatgccgacgtcggcctgaggcgactgaacgtgctctggcccaccgagggctgggagttggtcgccgcggtcgaccactccgccgccgcggcatcagagacttcgtactgcaccaggaaagatgtcgcgctctgcggaacgccttcgacgcagaagtaggtggcgttgccggacctgatgccggtctcggtaaggccgggcgtggtggcctgaaggtcgaggctgtcctcacacgtctggggagaacaggtcaggtacccgaaccggatggtcgtcgcgcttcccggcgcgcccgctgggcccggcactccctggggaccctgcgggccggtggctagctagctagttgcggaccggtgaggccgatgggaccctgcgggccggtaagaccggtggcgccttgcgggccggtaagaccggtggggccttgcgggccggtaagaccggtggcgccttgcgggccggtaagaccggtggtcccctgcgggccggtaaggccggtggcgcccgtggcgccggccgggcccgctgggccggcgacgcctttggcattccagctgatcggcgtccatgtcctggaacacggttgtgtgccggaatcgcggagcttcacctctccggcgctgttccggcaggcgtacatcgtgccgtccgccccgctgaccgcggcactcgcggaagcggtacccgccacgccgactgtcagggcaaccacggctgcgacggtcatcgtcctgtgcttacctgtgctcatgaggcgagagtcgggccgcaggggtgcaggagaggccttcgccggttgcggctcggtcgcaaacaccgcggctgcaaccgccgacctctccggtattccgtgacaaaagagaacaattctcgcttagcctcagtgacgtggggttacgccgggccgccacggccgtgctggtggtggtcctggcggcggtgacgatgctgaccgtcggccacgccggggccgccgtcacgtccaccttccgggaccgcttcgacgcgaacacgaacggttcgatcatcctgcgcggcaactcgaacctgacctgcctgctgtccgggcagcccacctgcccgcaggcccgcaacggcaccgccaccggagcgagcgcgaacaacaacagctacgcgatggcgtacaccgacgtcgacaccaatccgctcaccttcaacgacagcctggcgacgctggacatgccgcccggcagcacggtgttgttcgccggcctctactggggcgcggactcggtctcgccgctgcgcgaccaggtcctgttcagcacggacggcggtggctcgtaccggccgatcaccgccgccacgctgtttcccaacggcagcatctaccaggggttcgccgatgtcaccgcccaggtggccgggatcggcaacggcgtgtacgcggtggcgaacatccaggcgtcgatcacgtccggctcgtatgcggggtggtcgctggtggtcgcgtaccacaacgccgcccaggacatgcgcgcgctgcgcgtgtacgacggcttcggccaggtctccagcggcaacaccaacatcccggtgaccggcttcgagaccccgcacaccggcaccgtgcacgcgaaggtcggcgcggtggcgtacgagggtgatcgcggcacctccggcgacagcctgcaggtggacggccgctcgctgaccgatgcgcagaacccggcgagcaacttcttcaacagcacggtcagtgagtccggtacgccggtgggcggccgcaccccgggctacgacaacaccctcggcttcgacgtcgaccaggtcgacgcgaccggaatgttcgccaacgccgccacctcggccacgctgaccctgaccaccaccggggaccagtactacccgggcgtcctcaccttcaccatcgacctgtacgcccccaacatcaccaccacgccgtcggtggtcgacctgaacggcggcggtctggtgcccggcgacacgctggagtaccgcatcgcggtgcgcaacgagggcaacgacaccgccgacggggtcgtgctcagcgacgccgtcccggactacaccacctacgtgccggggtcgctcaccgtggcggcctcgccggtcaccgacgcgagcggcgacgacgccggatcctatgcggccggcgcggccgggtggacgctgggcagcatcccggtcgccggcaccacctgggtcaccttccgggtcaccgtccagcccggcgcgccacccgggtatccgatcaccaacctggtcaacgtcgcctattccgggcgcagcagcggggtgagcgtcaccgccaccggcgccaccaccgccagcgtcgtgctgcagccgcacgacgacctcgccgccgcgctcgcggtcaccccgccggtcgtgcagcgtgccgccactcccgccgcggtgacctacacggcgacggtcaccgacaccaccggcgacctggaaccggccgccaccgccaccctcaccctgcccgcgggcgtcacgcccgggatgatgccgaccggctgctgggccgccgggcaggtggtcacctgtgccctgggacccgtggccgccggcagttccgcgcatgccacggtcccggcgaccgtgagcgggtccgcggcggcgagcccggtcgccaccctgcggatcggtggcacgggagcggacgcgaacagcgcgaacgacaccgccaccgccacgctcgtggtcaacagcgcgccgaccgtcgtggccgacagcgccgccacgtcgttcggcacgcccgtcacgatcaccgtgaaggccaacgacagcgatccggacgatccgatgtccgccctggtgtactcggtgtccggtccgccgtcgcacggcgtggccgtggcccgcagcgatcagggcatcacctacacccctgccgcgggctggtcgggcaccgacaccttccggtaccgggtggacgacccgcacggcggctcgggcatcgcgaccgtcacggtgaccacgggcaacgcgccgccggtcgcgaacgacgacgtggtgaacacgccgacggacaccccggtcaccgtcgacgtgctgcagaacgacgccgaccccaacggcgacccgctgaccgtcaccgcggtcacccagccgccgtccgccgccggcacggtgaccttcacggacaccgacgtcaccttcacgccggatccggtcttcaccggcacgacgacgttcacctacaccgtgagcgacagcagcggcgacaccgcgacggcggtcgtgtccgtcgacgtggagaacgccgcgccgaccgcggccggcgacctgttcccggtcacctacccggcggcacaggccggcgtggtgctgccggtgaccgggaacgacaccgacccgaacaacgacccgctgaccgtcacggccgccggtcaaccggcggtgggcaccggcaccacgtcgctgtccgccggggtggtcacctacaccgcgccgcccggcttctccggtgtggccacgttccgctacacgatcagtgacggccgcggcggcacggacagcgcagcggtgacggtcgtcgtcgcgaacgcgccgccggtggcccaggcgttcgtgaccacgaccggctaccgcacgccgcgcaccctgaccgtgctcgccgcggccaccgacccgaacaacgacccgttgcacgtctccggcgccaccgcaccggcgcacggcgtggtcacccgcgacccgaccggccggatcacctatctgcccgacgtcgccttctcgggaacggactccttcgcctacaccgtcgacgacggcaacggcgggaccgacaccgccaccgtgacggtgaccgtcgccaacgggcttcccgccgcccgtgacgacgcggtcaccggcttcggcggcgcctccatcacggtcgacgtgctggccaacgacgaccccgatccgaacggcgagccgctgaccgtcgcgatcgacggtccgcccggccacggcggtgcggtggcggggcccggcgggcgggtgacgtacacgccggccgcgcacttcttcggcgtggacaccttccactacacgctcgacgacggcagccacacgctggtcggcgcgaccgtgacggtcaccgtggtgaacgtcgcgccggccgcccgtgcggatgcggcgatcatcgacacgaacaccgccgtggtgctgccggtgctggccaacgacgacgacgcgaacggcgacccgttgacgctgaccgcggtgggcacggcggcgcacggcacggtcaccgcgaacgccgacggcacggtcacgtacgtgcccgccaccggtttctggggcaccgacgcgttcggctactcgatcgaggatccggccgggctcgccgacgcggccaccgtcacggtcaccgtgcgcaacgcaccgccggtcgcggccgacgacaggttctccgtccggccggccacgccggccggactgtcggtgctggccaacgacagcgatcccaacaccgggcaggtcctcaccgtcgcctcggccaccacaccggcgaagggcacgctgacgctgaccggcggagtgctcacctaccgggcgaatcccggcacggccggcaccgacatcttcgactacgtggtcaccgacgacgcgggcgcaacggccacggcgcacgtcaccctgttcatcaacggcgtgccggacgccgtcgacgacgccgtggcggtaccggccgacaccgccgtcgacatcgccgtcaccgccaacgacaccgaccccgaagcgcagccgctgcgggtcaccgcggtgggcacgccgtcgcacggcgcgacccggatcaacccggaccagacggtggagtaccggccggctcccggcttcttcggcaccgacaccttcggctacaccatcaccgacaccgcggacaacacggcttccgcgcgggtcacggtgcaggtcgcgaacgcggcgccggtcgcgcggccggacaccgccgcactgctctccgaccggtccgtgctggtcgacgtgctcgccaacgacagcgaccccaatcccgggcagacgctgaccgtcgtcgcggccggccagccggcgaacggcgcggccaccctcgccgcgggcggcatcaggtacaccccggcagtgggctacgtcggccccgacacgttcacgtacacgatcggcgacggcaacggcggcacggcgaccgggaccgtcgccgtcacggtgtccaacggcgtgccggtggcggtgcccgacgcccgcaggacgccatacgggcggccgatcaccgtcgacgtgctcaccaacgacctggatccggccggcacgctggcggtcacctcggccggggtgccggaccggggcacggccacgttcaccccgggcgcggtgacctacacaccgccggccggtttctccggaacggcgacgctcgactacacggccgtcgacgacgccgggcaccgcaccggcgcgacggtcgcgatcctggtcggcgtgcccccgtcggtgccgaacaagcagaccaccgtgcgcgacggccagctggtgcggatcggactgccggccaccgggcaggacgggcggccggtcagcctcagcggtatcggccggccgcggcacggcacggcggtgatgaacgcggacggcacggtcacctatgtgccggatcccggcttcagcggcaccgacgacttcacctacgaggtgatggacgccgacggcaacgtggcgcaggcgacggtgcacgtgatcgtcccgccgccgccggcaccctcgccggtgccgtcgccgtcaccgtccgggccgccgtcaccgtccgggccgccgtcaccggccgggccgccgccgatgtcaccctcgccgtccgggtcgtccgcgccgtccgcgtcaccctcgtcgtccgcgccgcatctgccccggccgagccggagctcaccgaccccggcggcaccgcaccggaccgcgccgagtggagacacccggccaccgacctcgcccgtcaccggaccggacgccgcggccgtggcgctggccggcctgtgcgtcctcgcggtcggcgccacgctctgccggctcgccggccggcgcaccggccggccgcccaccggcggcgactgacgccgcgccacggggggttcagaccccggcggcggggagggttgacctcgacccgggttgatgtccgatgcttccgggatggacgtgaccgcatacctcgaccggatcggtgccgacgaccccggattgcgcgagctgagccgcgcccaccagcgcgccgtgccgttcgagaatctcagcatccatctgggggagaccatctcgctggacccggacgcgcttttcgacaaggtcgtgcgccggcgccgcgggggtttctgctacgagctcaacggccttttcgcgctgctgctggaagagctcgggcacacggtcgaccgggtcgcctgccgggtgcaccgcggggacggtgttttcggcccgctcttcgaccacctcgccttgatcgtcgacggtgaatggctggtggatgtgggcttcggccggcacaccatctatccgctgcggctcggcgaccgtgcggaccaggtcgatccggaaggccgtttccggctcgtcgacgcccccgatggcgacatcgtcgtgctgcgtgccggcgaaccgcagtatcggctggaacgccgggcccgtccgctcaccgatttcgcaccggcctgctggtggcaacagacctggccggaatcgcagtttcgccgggccccggtctgcacccgcctggacggtgacacccgcatcaccctgagccgccgcaccctgctgcgcaccgtcggcggcgatcgtgtcgagaccgaactgacctccgacgcggatctgctcgccgcgtaccgcacccatttcggcatcgaactggaccgcccgatcggatagctcaatccggccaggtgaaggcgatctcgtgttcgaaggcgcggaatccggcgcgcgcgaaagccgccgccatcggggtgttgcccagatcggtggcggcgcgaatccgcggcacgtcccgatcggccaggatccgcacgccggcggccaggatctcgtcgatgtatccgttgccgcgatgcaccggcgcgaccccgagataggcgatgatcgggtgatatccgttgtgggccgggatcacgaagccgaccggctcgccgtcgtcggcccggaccgcgacccgccaccagtcgcgcgggctgccgtaccgcgccagctcctcggcatactgctgttcggccgcctcgcgcgcggtcatccggcgcagatcgtcccggctgaacgcgtccagggtgccgtcgagcaccgcggtcatcaggccgatcagttcgtcggcaccgtgcgggggccggaagcgcaggcggtcgccggggtcgcggatcggcgtgccgggccgccattccagacgcagccgttcgacgaagagcctgccgcccgtctcggccagcagcgactcgcgcacctcggccgccgcgcgcgccgtctcccgccaatccggcggcagatagcggttgtactgcccggtcgggacggcggccatcgccgtgcgcagcaggtggcggccggcatcgatgtcggtcacgtcgaagatgtccatgagcgccggcagcgcgtcgccgggccgggaccaccagccggcccgggccacgacggtgccgccgcgcagggcgatccacagccattgcggccggcgccgcccggcctcgaggtcgccggcgatctccggattgagctggtagggcagcgagttgaacaggtcgatctcgccggggccgttgatcgggcgcacctcgaggggcacagcggagccttccggatgacggacggagactggcccccgcgtcgcgcgcgacgcgggggccatgaccataccgggcggaacatcgatcgtcatcacatatggtgccgtaggcggcgccgcatgacgtggccaccggtcgtcaccaggatcagcagcagaaggaacagggcggccaggaccggctcgtgctgctgcatggacacgacgccgccggcactgatgccactcatcacgtacgacaatgtgcgttgggttttcgggttgaacctcttcgccgatgccgatgccgatgccgatgccgatgccgatgccggcgccggacgggccggtgccggtgtgggcagcgccgacgggtcgcgcgggggctggtcgacgcgcaggtgggcggggacggcacggtcgatccagccgatcgcgtcgtcgccggcgcggtacagatcgggttcgaccatgatgcggatgccgtcggtgccgaccagcagccgggcgccgtccggccaggcccgcatgatcgagcatgccgcgtagcggacggtcgcccgggcatccggggcgatcatgctgatcccgtccgggccgaccagcagacgttccgccgggtcgttcagcgactcgtacgcggtgccggtgaccagggtgtccgacgcggtcggcgcgtgcgtgaacccggcccacccgccgtacgaaccgtccgggaccatcagcagcccgttcgcgctcgccgcctcggccaccgcgacgatctccgggagggtgaccgcctcgtacacccggaattccgcctcggccgagcgcaccggcagcccggccagcaggtcgcgggccaccgcctcgagccgctccccggactgctcggcctgccacagcgcctgcgcgcgctgccgcacgacggtcgacaggtcgtccggatggatccgtccggcgcgcagcgtggccagcacgtcgaggaattcgccgagcgccgccccggacttctcgggcagcgcgtcggcgaccgcggtcaccagcgcctgtccggaaccgatcggccgccagtgtgcacccaccgtgtaggacagcccggcctcctggcgcatctgccggaacatggtgcgttccagcacgtcggcgaagacctcggtggccgcgccgcgggcgacgagcgcgtcccaggccaccacgctgtcgccgccgctgaaccaggccggagtgaccggcagcgcgttcgacgggtccggcgcgggctcgcggcgcccgggcggcagggccagccgcagcccggccgggatacggtcgccggccacccacagcaccgcgttgtccctggtgaagtagcgtgccgcccaggtccgcaggtcatcggcggtgatcgcgggcaggccccactccgggtacgacacggtcccgtacccgatcgcgccgtgccgccacagcggtttcgggtcgatgccgcgcccgttcgcctcggcgcgcagcagatccttctccaccggcagccggtgcgccggcaggtcgtgcagggcggtgctgacccgggtcaggaacgtcgccacctcgtccggggtgccggtcaggtggaagctggtgtgctccaccccggtcgtgccgttgaagtggtggtcggtcatccccagcgagtgcagcgcaaggtgttccagcaggtgggtgatgccgtgccgggcgagcggctcgtcggcgaaacccacccggaagatcagcccggcacgcatcgggccggtgccgggagcatgcagggcgggcacgccgtccacgtcgtacaacgccgtcatcggacgccccccaccggcgacagtgaccggtcccgcagaccggcgaccaccgcggcgggatcgccgccgaggtagctgaacgggaaccggtgggccaggcggcccagcatcgcgaagacggcaccggccgccggccgctcgtccatcaggctgaacgccatcgcgaacgcgctcgcggccggcacccagcccggctcccggcggaaatcggcgtgccagaccgagcggtgcgcggcctgcgcgaccgcgtcccggacggcttcctcacgcaggtacgcggtggcttcgggctcgtcgagctccagccagttctccaggtgggcgatggcgaccagcgacccctgcgccgcgccgggcggggcggccgcggtcgcctcggccgcccacgcgtgcgcccgcggccagtcgccgccccatttcgggcacaggctctgcaggtattgcgcctgtccggcgtagtcgtgcgggtgggcggccagcatccggtcgtaacggcggcgggtctcggccggccccagctgcaacccgcgggcggtggtcagccgggccgcccagagcgccgggtcgccgggcgtccgcgcggcgccgtcctagctagctagagcagcgcggcggcggcgccgtccgccgggtcggcgtgcagcgcgtaccgcagcgtctcctcgatgccgcgctcctgcgcggcccagctgagcagccaggtccgcccgcccggggcggcgctgtcgaggaccgcgcggcaggccggccagtcgcggcgggcgagagcggcgcggaccacggcgagttccggatgcgcgtcggccgggtcgaggagcacgtcgtcgaaggacacgccggaatgttccggccgcggggttgcgaatcgggtgcgatcggcgatcacccgggttgtcgtgccggccgcggcggcgcgcatcatcatcggatggaacatgtcccggtggtgatcgtcggcgccggcccgaccggcctgaccgccgcgctgatgctggcccgtcgcggtgtcggatgtgtggtgctggagcgcttcccggagccgtatccgctgccccgtgccgtgcacttcgacgacgagatcttccgcgtcctcgccggcctcgggctggcggccgggctgcacgcgatctcccggcccgcgcccggcatgcaactggtcgatccgtcgctgcggccgctcgccaccttcgaccgcgagcccgccggcgagcacggcttcccgcaggccaacatgttcgatcaaccggatctcgagcgcctcttgcggcaggcgttgccccacggagcgcttcgcgccgggagacaggtgtacgacgtggagcagccgccgtccggtccggtcctcgtccgttaccgatcagtggaggggccgggtgaactgaccgccgacttcgtgctcggctgcgacggcgcgaacagcctggtccggtccctgatcgggtccacactcgacgacctgggcttcacccagcgctggctggtggtcgacgcgcagggcccggacctgtccgcgtacccgggggtgcagcaggtctgcgacccgtcgcgggcggccaccttcatgatggtcacgcccggccgatatcgatgggagttccgcctcccggtcgaccggtcggtgccgtcgctgctccagccctggctcagcgggctcccggacccgggggcgctgagcattctgcgtaccgccgaatacaccttccgcggcgccctcgcctcccgctggcgggaccgccgggtcttcctgctgggcgacgccgcccacctcaccccgccgttcatcggccagggcctgtgcgccggcatccgggacgccgccaacctgacctggaagatcgcgttcgtgctgtccggccgcgccgacgagcggctgctcggcacgtacgcccaggagcgtcgcccgcacgcccgcagcatgatccggatggcgatgctgatcggctgggtgatgaccggcggcagccgccgctcggcggcactccgccgttttctgctacgcaccgtcaccagactgccgggcgcggagcgccgggcgatgaacgtcgcgtggccggcgttccaccgtggtccgctggtcggcccgggcggtggccggctctgcccggccgctctcgacgagtcgctcggcgacggcttcgcgctcaccggcggcctgctgatccggccggaccgggtcgtcgcggccgccggccggcacgcccgcaaggacttcccggccgccgccggcatccacgattccggcctgtgagctgggcttccggatttttgtcgtacgtctcggctagaactgtccccacgtgaaccacaggggagaggactggttgtgacatccgatgacgtcgcctacgagcggcgcggctcggcatccgtgatcgcgccggtgcagccgcgcaaactggccaaggtgccgttcgtcgagctcgccgacggccggctgcagggcgtggtctccagcggctccgacatcgagcgggtctacgtttcgtcgatcaccgtcggtgaccatgggctgagctgcaacaccaacaacaaccgcccgtgcggcggcctgtccggcggcacccgggcctgcaaccacctgcgcgccctggtcgaggccgccgtcgcgcagtatggtgcggcccgcgtcgcgcgctatctgtcggccgacgacgccgaggacctgtgggccggcctgcatccggtcaccgcgccgaaccgggccgccgaggtgttcagcggcttcctgcgccacctggcctatctggaggtcgagccgaccaccgacccgctgcccgagctgcagtggttcccggccgcggcggcggtgcgctgatgctcgccgacgcgctgcgcggcctgccggacggcttcgccggcaccctcgccctggtcgacggggtcgacgacacgctgacccagggcctggcccgcgccgacccggccgcgctggaggctctcgtcccggcgttcgccggctcgccgctggccgagcgggtcaccgaggcgatcggcaagatcgtggccggcacggtcaccgacgagcacctgctcaccctggccggggcgcgcaccgcgctgctcggcgccgcgcacgacgcgctgcgcgacagcctggacaccgccctaggccgagcccgcgcgccatggtcggccaccccggccgcgaccgattccggtcaggtcctcgccggcgcccggtcgtggctgcgcgagctcgccatcgccggctggcgcggcgtcgaccacgagctggccgggggcgccgggccggccgtccagacactgctggccgacccgggcgcccggcggctcgccgtgctgctcgacggtctcgccgccgagttgcggacggccgcgccggtcgccaccctgccgcggatcccggtgcgccggtgggccgacctgtggacccgcgcgctgctgctcgcccaaccgggccggccggccttcgccgccaccccggtcgacgggcggctgctgctgctcggcgtcgacctgcacgagcatccgacggtgttccaggcgcaggcccacgctctgctggagaccgccgacggcgcggtccgcctggtccgcaccagcgtggccgccgccaaggtggacacgatcagcggcccggccgcgtggcggatgctgaccgccttcccgacgctgcgccgcgcgctggccgagcaccgcgtcgtcgaggtcgccgggatggcgctgacccccggcggcgacctgatctgggacgaggcgcgcgccacggcgggtgcgccggccgaccccttcgcggccgcccgggtgcggctcggcacggccgccgcgctgccggtcaccccgctcgatcggcacccggcggcgctggccgagccggtgctgctggagggctacggccacaccgatcgggcgttcgacctgggcggcggcgtcaccctggcggtcgacctggaccggctgcccgcggccgggccgctcacccccgagctggtcgccgcctcgaccgcctgcctcggcctgctgcgctgggacggacggtggctgctgcagccgctggccgtgcagacgctggtgaagaagaagccggtggccgtgcacggcggcgactgggcgctcggcccgaccgaggcgaaagcggccaaggccgaggccgccgccggcaccgcggtcgacgtgttgcgcgagcgcgcgggaaggctgctgcggaaatgagcgctgcggagaatcgccggcaggtgctgtactggcggctgctggcccggctgttcgacccggaggagcaggccaccctggagtccgcctcgatggccgtcgtcgacgacctcgggctgcccgccgcgctgctcgacccggcggtgtcggtggacaccgtcgtgcagcgcttcccgcacctggcggccgagttcgacaccctgatgagcgatcccggagacgaccgggagggcgaggtgcgccgcgccgcgctggtgtcgaaactgctgctcaacgtgttcgccaccgggtccggcagcgtgaccgcggggcagttgcagggctggcaggccgacgccggctggttcgagcgggcgatgggctgcgagcccggccggctgcgcggccgctccggcgagggcgaggacggtctgggccgggtgctcgccgggatcgagggtgacctgatcagccggatgcggctgcgcgaggtgctcgccgacccgcggctggccgggcagctcaccccgagcatgtcgctgatcgagcagctgctgcgcgacaagcacaacctggacggggtcgcgctggccaacgccaaggcgctgatccgccggttcgtcgacgaggtggcccaggtgctgcgcacccaggtggcccaggccggtgccggcacgatcgaccggtcggtgccgccgaaacgcgtctaccgcaacctcgacctcgaccgcaccatctggaagaacctgccgaactggagccccgacgacgagcggctctacgtcgaccgcctctactaccggcagaccgcgaaacgcgtcgagccggcccggatgatcgtggtggtcgaccagtccggctcgatggtcgactcgatggtgaactgcaccatcctggcctcgatcttcgcggggctgcccaaggtcgacgtgcacctgctggcgtacgacaccgtcgccctcgacctcaccccctgggtgcacgacccgttcgaggtgctgctgcacaccaagctcggcgggggcaccaacggcacggtcgcgctcgacctggcccggcccaggatcgccgacccgcgtaacaccgtggtggtctggatctccgatttctacgagtggcagcagcaggccgtctgggacggcatgcacgccattcaccggtccggagtgaaattcatcccggtcggctcggtcagcagcggcggccaccagagcgtcaacccgtggttccgccagcgcttcaaggaccagggcaccccggtcctgtccggacacatcaagaagctcgtcgccgagctcaagaacttcctcgtctgaccttcccctggagacaacccatgagtgacatgctgcgcgcccccgccgaggtcaagtacgccgacgagctcgactggctcgagtcggtcgacgacggccccaagccgttctcctggcggctgagcccccggatggtccggctgttcatcctcggctcggaacgcgccgacggcctcgaccgggagatcccgcagaaatggttcggtgaccgcagcttcgtcgagcgggccatcgtcaccctcgcctccgaccgcggcctgctgctgatcggcgacccgggcaccggcaagagctggctggccgagctgctcgccgccgcgatcagccgcaactcgacactggtcgtgcagggcaccgccggcaccaccgaggaccacatcaagtactcgtggaacgtgtcgatggtgatcgccaagggccagtcccgggcctcgatgatcccgtcgccgatcatgacggccatggagggcggcgtgatcggccgcttcgaggagctcacccgctccaccagcgacgtgcaggacgcgctgatctcgatcctctccgagaagtacgtgtcgatccccgagctcgacgacgacaacatcgtcttcgccaagcccggtttcagcatcatcgccaccgccaacagccgcgaccgcggcgtcaacgacctgtcctctgcgctcaaacgccggttcaacttcgtccgcatcccggtcgtgacgaacaggaagagcgaggcggagatcgtccggttccgcaccgaggagctgctgcgccggcacaacatcgagctcgaggtgccgcccaccctgctcgacgtgctgctgcagagcttcgccgacctgcgcgccgcctccgccgcggcgagcagcgacgacgagcggctcgagtcggcactgtccaccgccgagcagatcggcgtgctggaggacgccatcctgcacagcaatttcttcggcgcccgcacgctcacctcgcaggcgctggccgggtcactggtcggctcgctcgcccggcgcagcccggaggatctggcgatcctcaacaagtactggcacggtgtcgtggagccgcgcagcagggagcacagcggcgagtggaccggcttcctggagggcggccgccaggcgatcgccaccctgtcatgaccgccttcgacgccctgcgcgagcagctgctcggcgccgcccgggccctcggcggcggaccggacgcccttcccgagatcctggccgggatggtcgacgatgtcgaccacgcgctgcgcgagccgctggagatcttcccggtctgccaccactcgccggcctcggcgctggccatgctccgacggctgcgcgagaaacagccccgggtcatctatctggagctgtgcgaggacctgcagccgctgctcaccgagctgcgcaactgcaggctgccggtggcactgcaggccttcgcctcccgcttggacggcttcccgccggaatcggcgccgctgtcggtgatcgcgccgatcaccgaggcctccgccgaataccaggccgtcgcgtacgcgttgaacacccccggcgtcaccctggtgctcgtcgaccgctcggccgaccacgtcttccagtggcaaccggaagccacccccgaggccggccccgagcccgaggacgacctgcacggcgacgcggtcggggtggagatcggcgacctgcggccgcgcttcgccgagctggaggagcacctgctgcaccacggccgggtgcggcactggtcggagtggtgggaccagtacgtggagcagcccctctccggggccgggcacgacacgtaccgccaggtgatgatcatgatcggcagcctgttccggcggctcgcgccacacgacacccgccgcttcgccggcgacgaggaccgggaacgctacatgtggacccggatccgcgcgcacctcgccgagcaccacatcgacccggccgacggcatgtacatctgcggcgccttccacgcggccagccggctgccggaggtcggctccgcaccgggcacccccgacttcgcgatcaccccgcggaccgggaccacctggctgtacggtctgatcccgtccagccactcggcgatcgaggcgcagttcgggctggccgccggctcggtgtcgatcgcggccgccacctggcagaaacagctgctccggtcccggctcaagccgttccgcctggacgggcagaaaggccgcccgctgccgctgccggtggccggcacccagccggtcaccgatcagctcaccgactatctggccgggccaccggtgctcgacgggctcgacgaactcgagctgcgcggctggtgcgtcgacatcgtccggctcgcccgccgcaacggatacctggccagcacggccgacgcgatcgcggtcttcgagacgtcgatcctgctcgccgggatgcgcgggcgggcccggccgacgccgtacgacttccaggacgccgcggtcacctgcatcgagaaggacaccgtccccgggcggcgcgacgtccggcggctctgcgaaatcctgctcggcggcgaccgggtcggccaggtcggctacgacgcgctgcccccgctggcccgcgacgtccacgaccggctcgccccgctcgggctcaacctggaacaacgcagcatccagcgcgcgctgctcgacctggccgcccggcccgagctggccgcctgctcccagctgctgtggatgctgcgctacctgctgcccgaccacgccgtccggccgatcatgggcagccgccggctcggcgagaagcccatccaggaaagctgggacctcgacctgggccggcaccagcgcagcatcatcgagctgggctacgagggcgtcaccgtcgagcaggtcctggagcaccgcctgcgccgcgacgcgtggcaccccgaggcgaccgcggccaccgccctcaaagccgtcgaagactcgatgctgttcctgcagagcccccggctcaccgacgacctcggcaaccgcgccgtgcatctgctgtccgccgaacgcaccgtcgacgacgcccccgccgtgctgcagcggatccggcggctgctcgggcactaccgggccaccacgccggccctgccgtcctggtgcgagcggttcgtcacctccggctacgcgcactactgcacgctgctgccgaccgcgttcgtcgacgaggagaccggggtccggcaggtgggcgcgatgctcggcttcctgttcgggatggaaagcctggcgctgtccctcggctgcgaccggacccagctggagatcgccgtacggcagtcccatccggagtcgccggccaagctggccctgctctgggcggcccgccaccagctgggcgacctgcccttggccggcctgcgcgaccgggtcgacgaactgctcggcaacccgctggtggtgccggccttcccgcagtacgtgagtggcttcgtgcaggcgctcgaaccggttccccggctggcaccgttcgtcgtggaaaccctgtcgaaagccttcgcccgactgcccgacccggtcctgctgccctggctgccccggctgatcaccacgttgcggcggcagggcggtgacctgctgcccctgctgacccgggaggccggacgcaccttcccgggctcactggccgccctggactcctggactccgccctggctcgcgccgtcgccgaggctgttcccgccggcctcggcgcggaccgatcgcgggccggtcagcgtgttcctggcggcgcatccggcggtgacggatgcggtagccgggctcctggggggtgccggcgtcctgggccgcgttcccggagccggccggagggcccgatccgctggcggccgccgggtcgtatccgttgccggtcgccgggtcggatccgctggtggtcgccgggccggatccgttgctggccgccttcccggtggcggctgaggccgtggccgatctgctcggcgtgtgatccccgcccggcccggggcgctgcggcggtccgggccgggcggtcgcggccttccgggaggtgcggcggtgccgtggtggggcgctgttctctcagcttcggtcccggctgaccgacaaggctgggcggcaggggaggaaaccgtgaaggctgaccggcaccacgatcgtctgggcggcgggacggctcgccgggggtcggggcaacccgacgacgccccggcggcacggtggcggcgcggggctctcgcgacgtactacgtggcgttgaccgtggccaacctgatgctgctcagcggggtcgcccgggtggtgctgagcgggctggccgcggcgaccgccgtgctgctgttcgcggcggcgacgctcggcgcggtccggcggggtttcggccggcctgggcgcgcctgggagaaactggcgtatcttccgatgatcgacgccgtggcgcaggtcgcggtgaccggagagctccatcacacgacgacgctgctgctcaccctcgtcggggtgggcggcgcggtgccggaccggcggatcgcgatgcgcgccgccctgctcgggtgcgtcggctgggccgcggtcgtcatgctgcagcacgggctgcggacgccggagctcggcttctacggcgggcagctgctggtggcggtggtgctcggcgcgatcctgcacgaggcgctgcggcgtcgccagcgggacctgaaatcggcacgggaccagctcgcggtggtcctcgcacgcttcgagagcctgttccaggcctcgccggccggagtggccgtcgccgacgagcacgggatgctggtcgcggtcaacccggcgttctgcgacctggtcgggcagcccgcgagcgaactcgtcggtgccagcgcccacgcctacctcaccccggacggggaggggcccgtcgcgccggagccgggcgacggcgggcacccggcctcggctgccgccggcgccggcgttgccgtcgacggcgggcaggagagtgcggcggggcggtcgatgcggttcgtgcggccggacgggtcggtgcgctgggtgtggctgacggtgggccgcaccggggcgccggaccgcagcgacaagcggcgctggatgctgcttcacctgcacgacgtcaccgaccggcacctcgccgaacgcgccctgcgggaatccgatcggctgctggccgcggtgtccgtggcctcccggcggatccgcacccggcaggacgcccgcggcaccatcatcgaagcggtccgggaactcgccgaggccgactcggtcaccatgctcgaacccgacggcaccgacctggtcgccaccggcggggtcggcgtcccggtgatcggcacccgggtgccgatggacggcacctccatgatcgccgccgtctaccgggatgggcagccggtcttcctcgccgaccccggcaaggacccgcgggtgtcggcggccctgctgcggctcgtcgacgccagctcgatgatgtggcagccggtgatcgccgacgaccgggtggtcgcgctgctcgtggtgagctggcaggcccggatctcctcggtcagcgacctgcgggcccgggcggtcgccctgctcgccgacgagaccgccctcgccctggaacacgaagggctgctcggccggctggaacggatggcgtacaccgacatgctgaccggcctgtcgaaccggcgcgcctggcaggcgggtttcgccgaacttctcgtcgccgcccgcacggacggacgcccgctcaccgtggcgatcgccgacctcgaccatttcaagcggttcaatgacacgtacggtcatctcgccggtgacgaactgctgatcgcgaccgcgtcggccttccgcgcccagctgcggtccggcgatctgatcgcccgctggggcggtgaggaattcgtcgtcgccctcccggacagtaccgcgcaggaggcggcggcgatcctggaccggctgcgcgagtcgacgcccggcacggaaacctgcagcatcgggtacgcggtgtgggacggcgccgagtcctgcgaacgcctgctggggcgcgccgacaccgccctgtacgccgccaaggccgccggccgcgacacggtccgcgccgccgatccgacgggctgcgacacgcagccgggcccggtggggatcacggcggcgagacgttagcggcggtcggtgacctgcgatgcctgcggccgcgggcggctgccgaccgccctcgcccgggcggcccggaggctccggcagcggtcgggtgtcgggcggcgtcggctcgcaatgtgtggcggtcgggtgtcgggcggcgtcggctcgcagtgagtgtcgggcggcgtcggctcgcagtatgcggcggtcgggtgtcaggcggcgtcggggggcagcgggcggcggccggcaatgcccaggtcggggcggtgataccaggcgaggtcggtgtcgccctccagccagcagagcaggaccgggctcccgtcgaggtcggcggagaagtccaggagcaggggagcgacgcccttcagctcggcgcccgactcctggatcgtggtcatcagctcgttgaggcgggcctcggccgccttgcgctcgggcaggccgcccagcgtggtcggctcaccacccggcaccagcgcggcggacagctccaccatgtcggcccgcagcgtgacgatctcgtcgaggacgggccgcagccgggccagttccgcgcgcgcctccgccaccgtgaacagccccatgcccgccagttaaccacccacaggatcggcgtcactcaccggtcgggcggcggcgctccggtccgctgctgccggatccacgcctcgatgtcggggatcagccagacccggcccatcgccagctcgtcgaagggcgacgggaagtcatcccgctcggcgagctgctgcacacgctgccggctgagccccagccgcttggcgatctcgccggcgcccatcaggtgtctccccatgaaccgactatagtcatcagtcatcttgtcgcgcgataaacagtcgcccgttcgggatcggactgggatccggaatggacagggagaggtccgccggatcggccggctgcggggccaccgccgggtccgcacccccgcgccggccggcacgtcggtccggtccggtcacggaacccgtcgccgcgagccgggttcagctcccgtctgtcggcggctcgtgaaagttcgcctcaggtcgcggcgcgggtgatggcgaacatgaagcagccgtaggcgacgttccggctgtgcacctggacgacgtccgggtcggcgaacatctcggcgagcacgccctccgggtcggtcccgtcgtgcacccgggtgttcggatgaatccagccacgcggatcgtaggctcgcagcacctgtggccgcccccgccagccgtggggatagccgtcacccgcgggcccggtgcacccggcggcgtgggcgaagaccgccccggcctcccggtacgggctcggcgggatcggcggcgcgtaggggaacaacaccaacacttcgccggccagtgcatcgcggaggcagcaacgcagcggttcgccgccccccgcgacgatccgcacgacttccggttgcccgcccacactgtcctggcgcgcccgcttcaacacatcgagcggcaacgcgtgcaccttgaattccatgccgcccatcgtgcgaccgcaccggcagcatttccggcggaaatcggacctcacatcgatccggccgacaggcagcggtgtggcgccggccggtggcgggtctgtcgggggcggggccggccggtggcgggtctgtccgggacggcgccggccggtggcgggtctggtcgggggcggggccggccggtggcgggtctgtcggggacggggccgaccggtggcgggtctgtcgggggcggggccggccggtggccggtccgtccgtgagggcgccggccgggtgggatcgttccgggctggtccgggttcaggcggcggatcgggagatgtcgagaaggtggtggacgatctcgtggaccgtgtgccggcccacccacagcatgctgcgggtggcgggctccggccagctgtatgtcgcggagcgtctcaactcctccggtgccaacgcggcgaaagcatcggccagggctgcggcggcctgatccaattcggacaggacggtgtgggggtcctgggtgttgtaggcgtccagggtggcccgctcgtcgcggcccatcggcgcgaagaccggctcgtcctcggcgagcgccaaggccaggcgctcccgctgcacacggagcacgtcccggacgtgacaggtgtattccagcggtgaccacaccgccggcgcgggccgcagccgcaggtcaccggcctgcagcagcgccgcggcgaacagcgagccggccgcccgcagccgcccgggcagcgcggcgggagctacggtcgcatgggtgaagccgcattccgcgcagtgatcggtggccagcgcgaccagcagatccacctccgtgcccaccgccagcccaggatgcccggcagccggggccggccgggtcggcgcaccggggtgcgcgtcggtcggggtgggttgggtgggcagcccggggtgcgcgtcggtcggggtggattgggtgggcagtccggggtccatgttggccgggaccggtcgggtgggtgggccggggtgcgcgtcggtcggggtcggcttcgggcgcgtggcggccgtggccgggtggatggccggcccgtggcttctgctcagcaccgggcgggcggcctggaagtgcaggtagccgccgggtgccgggatgatgccgcggcccgggcgggcgggcggcacggtcgcagcgccggcggggtgcacggcggacgccgccgggtcgtcgaggcggagctccaggcgtgacccgaaatgatcggtgacggcgggcgggaactcggtccagcgcgacgccgtggccaccaggtggacaccgcgcccggcgcctttgcgggcgatctccaccagcaggtcgtgccagttcggatgctcgtcccagaactccgcccacccgtcgatcagcagcaccgtgtctccgtgcgggtcgtccaggcgcgcgtacagctcccgcttcagatcgtcccggatgtccctcaccagggagatccggcgacagtcaagagcttccggcgccagtacgcgcacctcgggcgccgtgtgggacaacgcgagcgaagctgtcaacgtacgcaggatcgtggtcttgccgctgcccgggccaccgacgaccgcgacgtgcccggcgaccgggagccagatgatgtccctcgcctgttcccgtggtttgtcgaggatcccgatcggtacctgcagcgccccgcgcagggtctcgtcggcgaagcgcaagccgtgatcaggatcggacacgacggcaccgcccagttcgtccagcgcgggtgccgggccgagcggcggaagccagatcgggtgggccggccccggcgccgcgtggtcgatcgtgaccgcggcgtgggcgggcggctggaaggggatccgctgatcggtgccgatccgcagcagcccgggggtgatccggtaggagaggtaaccgtccagttcatacgtttgcggcgtctcagtgccggaatcggccagcaccaggtggatcccgcgggcccgcccgagccagccgatctgccggatcacctcgagcagggccgggctcgccgcgaacagcgcggcgaatccatggcacaccacgatcagcgccggcatcggcacccggccgccgacctgccgcagatattcgctgtgactccggcacccggccgccaccagcatccgtttccgccgggcgagttcgccttccagcacctcgaccagccgcggcagcagcgacaacccgctcccgcccggaagaagcgacccgcccccgggcgccgcggcggcgaatgcggtggcaggtggggaagcggcggtcggcaccgccgcgagcggtgcggtggcgggcggtgcggccggcggtgcgatcggcaccgccgcgaacggtgaggtcacgggcggtgcggcgggcggtgcggcggtcgcgggcggtgcggttgtgctcggcgtggcggtggttggtgtggcggagtgggcgaacgggcgtgcgtcgagcagcacttcggtgtgcggcagccgttccaactcggcgagcgtgccgtcggtggtcgcgtccaccaggacgaacgacgcctcgtccggggtgtgcgcggtggccaaccccagcagcaccgatctcagcagagccccgctgaggctcccggtgatcaggccgtgcggccccacaccgccgtcgacggcttcgcgcaggtcgaggtggacgggactgccgtcgggcgcgtgtccgatgacgacccggagccgcgggcggtctgtctgggcgggaagcacgcgcccgacggtagtacaggaaacggggtcgccggggtctgcccggagggtgtatgctccccggcgatgaagacctcctcttccggagagggggccatgtccacgccgagtgagtgctgatgcaccctgtcgtggacgggcttccccgtctccttgcctggcggcgcgtgcgcgagttcgctgtcccgccgtcgatgatcgaaaccgctaccgcccgccgccttgtcggtgactggctcggtgcctgcgccgcggcccgggtcgaggtgaacctggacctgcgggccgtggcccgccggcacggtcgtgagctggccgccgggatccgcgccgacctcaggcatctcgcaccggacctgctgcgctggcatttcccgcgggtcgagtccgggctgctccggcccggcctcaccgtcgcgctggctcgttacggcccgcggctggtgctggtcgcccgcaccgctccggcctgggccgacgccgaccagcggctgacgctttcgctgtggggcggcaccggcgacgaggctcgcggcgacgattcccgggtgcatccgcacccgcggccgcaccgccggttccgcctcgacctgcaccggcacctctgggatgcccgtcacgccgctgagctgcacgaacgttgcggcgcggccacctggccgggtgacccggacggcttggcgatgcaccgttggcaggcggaggcggacattctgcgccgcgctgaagcggcctacgcacggtccgccgcggcggaggcgtcgtccttcggggtggccggccaggcatggtccgcggcggcggaggcatcgtccttcggggtggccggccaggcatggtccgcggcgacggaagcgccgcccggccactttaggcaggcggtcgccccggccgacgaagcagttttggtacgtcttcacgcgcgcgacatccgtcaactgttgccggccgccggtgcatcggccggcggtggtggtctgctgctgcccgacgccgccacccgggtgccacccgatctggaactgctgcgtgccggcctgatcgaacccggtcacctgcatcctctggtcgccgagtcgctggcgccgggcagtcatgttcgggcggtggctgccggggattccggtccgcggttggtcgactgccgcgggcaacggcatcgcatcgagctcgtcgacggcgtgctgtccgcgatcgatcaccatccggatgagctgcgccgggaggagatcctggtggcgttcggcggcccgccgctgccctgcctgcgggtgatcgacgacgcgatccggcacccggaggatctcgacgacatccgggcccgcctcgatcacggcaatctggccggcgcgatgcgggcggtggagtgcctgctcggcccggctgcggtgctgcgcgacggaccgctgcgtgacgagctggagcgtgccggacagcggtacgtcacctacggcctgtaccgctccggtctggccggccgctgcccgccaccggacgaccccctgccgcgcgcccgccgcaggaagcgcatcgaacgcaacacggccgcgaagaaggacagctacgcggccgcgaagaaggacggcggcacgcccgcgaagaaggacggcggcgcgcccgcgaagaaggacggcggcgcgcccgcgaagaaggacggcggcgcgcccgcgaagaagaacagcaacgcgggcacacaggcaagaacagcacggcggccacgaagacaagaaacgtggccacgacgaaccgaaccggaaactccgcgagcggaggccccccaacgacccctgaggtgactgactacatgactctcgacatcgccgctgaactgatcggcctgctggccgacacgaccaccgagccgcgtccggacatccagttggaggcgctcaccctggcggtcgccgccgatctgccggtgctgctctggggcgaacccgggatcggcaagaccgccgcgctccaccagctcgccgcctccctcgacctgccgctgaccacggtgatcgcgagcgtgcacgagccgaccgacttctccgggctgccggtgatcggcgccgacccggccacccagggggtaccgatggcgccgcccgactgggcggtccggctcgcgaacagcggccgtggcctgctctttctcgacgagttgtcgaccgcgccgccggccgtgcaggcggccctgctgcggctggtgctggaacgccgggtgggcgcgctcaccctgccgccgggggtgcggatcgtggccgccgcgaatccgcgcggatcggccgcggacgggtgggagttgagcgcgccgctggcgaaccggttcgtgcacctgcagtggacgttcgaccacgaggtggtggtgcgcggcctgggcgggacgtggccgcgggcggcgctgccccggctcgaccgggcgcggctggcgcaagccgtgacgtacgcccgaaaagcggtgaccgacctgcttaccgtgcgaccgaagctggtgcatcagattccgcagtcggagtcgaagcgcggcggtgcgtggccgtcgccgcggacctgggacatggcggtgcggctgatcgcgttcgggatggccgccggtacctcgcgggaggtgctgtcgatgctggtccgcggggtcgtgggggacgggccgggcctggagttgctggccaccctggaccggatggacctgcccgacccggaggcgctgctcgccgatccggtgggggccgtgctgcccgaacgcggggatctgcggcaggccgtcctcgacggggtggtcgaggcggtccggcgcaacccggaccgggaccggtgggatgccgcctgggcggtgctggtcaaggctctggcgacgggtgcgccggacctgctggtggtgcccgccggaaacctggccgagctgcgccgtgacgactggccgctgccggccggcatcgaacagctggccggtgccgtcggcgtggcacggctggcgggccgatgaggctatcggaagcggacaccgagaagttgtacgcggcgcggctgttcgccgtgcgggcccgcccctacctggcttccgcgctgttcgcgctgaccgtggtcgagtcaccgcgtacgccgacgatggcggtcgaccggttctggcggtgctacgtctcgccggcgttcgtggcgcggaccccgctggcggagctcgcctcggtctgggtgcacgaggtgtcgcacctgctgcgcgaccaccatggccgcggcgaccgctatgcccgcgagcgcgatctgcgcgggccgggggagcggctgcggatgaacctcgccgccgactgcgagatcaacgacgacgtgtacggggacgggctgccgtgcccgcccggggccgtccgtccggtcgatctgcggctgccgccggggctgttgatggaggactatctggggcagttccggctgggccggcataccgacgcgtacacctggttcgattgcggcagcggggcggacggcgcggagcgggagtgggatctcggcccggacggtgcgcatggactcaccgatcaggagcgcgacgcggtccggttccgggtggcccagtcgatcagcggggcgcccgggaacgtgccggacggctggcggcgctgggcgcaggaggcgttccatccgccgcagccgtggcgggagctgctcggggcggcggtgcgcgcggcggcgggggcgcgcggggcgggggaggactacgcgtacggcaaaccggcccggagggcggcgagcctgccgcgagtgatcctgcccgccctgcgtcgcagccccccgaaggtgtgcgtggtgatcgacacgtcggggtcggtgagcgacgaggaactcggcaccgccctgctcgaggtcgccgcgatcgggcgggcggtcggcggacgccgcggtctggtcagtgtggtggcgtgcgacgcggcggccggggtggcgcatccactgtgccgggccgaggggattcccctgatcggcggtggcgggaccgatctgcgggaggggttccgccaggcgctgcggacccggccggacgtgatcgtggcgctgaccgacggctggacgccgtggccgagccggcagccgccgtgccgcacggtgatcgggctgttccggcgccgcgagccgctcacccaatggccgccggaatgggcacgtgtggtaaagataggatgattacggagaaacacgaataaagcccagattgcggcattaggttagggcctcgtggtcctacgacgctgtccgcgccgcctcacggtgctgctcctgctgatcctgtgcggtctgacggtgcccgccgcccggccgcgcccggcccgggcggcgcagaccacctgcgcgcccggcgtcacgctgatcaacggcgacttcgagtccccggcgatcgcggcgaactcgatgtcgctgatcaacgagggtccggacatgccgggctggaagaccaccgcgccggaccacgtcttcgagttgtggcacgaggtccggcagggcttcaacgccgcgaccggggtgcagttcgtcgagctgaacgcgaactacgtctccacgctgtaccaggatgtcgccaccacgcccgggcagacgctgcgctgggagctgcggcaccgcggccggctcggcaccgacgtgatggccgtcaggatcggcccggccggcggcgccctggtgcagcagggctcgacgctctccgacgtggccaccgcgtggggcacctggtcgatgaactacaccgtcccggccggccagacgaccacccggttcgccttcgagtcggtgtcggccgcgcagaacaagcccacctacggcaacttcctggacggcatctcgttcggcaccgcggcctgcctgctcaccaccacctcggtcagcgcggccacggccaacgtcggcgacgtgctcacctacacggtcaacgcggacaaccgcggcggcaacccggcgaaattctccgtgctcagcgacacgctgccggccggcaccacgttcgtgcccggctcgatccgctcgatcaccggttccgccagtaccgcgatcagcgacaacgcggacggcgacaccggcgaatacgattcggtggcccgcaccgtgcgggtccgggccgggaccggcgccaccgcggcctccggcggacgtggtcgcgaacgtgccgttgaccgacgcgctgagcgtccaggcgcagaacaccgcggcggtgctgccgaccacgtacgccgcattgagcagcagcgtcgcggtcgccgtgccgcaaccctcgctgtccgtcctgctgtcctccacggtcagcgacccgacccggcagaacgccgccgcggccggcgacctgatcacctacggctacaccgtgaccaacaacggcaacgtgcagatggacagcatcgcggtcgccgacaccaaaggtgacacggtgacctgcccgcacccgacactcgccatcggtgactcgatgacctgcaccgccagccccgggtacacggtggtgcaggccgacgtcgacgccggggtggcggtcaccaacgtcgcgaccgtcaccaccgtgccggccggcggcggcagcacggtcaccttcacctcaccggccggcggcgtgcaggtggccgccgccgtgccggcgctgcggatcaccgtggcggccagcaccgccggaccggtccggctcggcgacaccatcggctacgactacacggtcgacaacctcggcaacgtcaaactggacaacctcggcgtgaccgacgccaaagcggccaccgtcacctgccccgcaacggtgctgccggccggggccaccatgggctgccactcgtcgtcgacgtcgtacaccgtcgggcaggccgacatcgacgccggcgtgccgatccgcaacgacgcgatcgtcgacgccctcagcgtcgcacccgggcacatgccggccagcgccgagagcaacgcgccggtgccggtcgtcgcggccgcgcccgcactcaccctgaccagcatcccgcacgtgacaccggccgggcacgccgccgccgcgcagaccggcgaccaggtgtacttcacctaccaggtgcacaacggcggcaacgtcaccatgcacggggtggcgatcaccgacaccctgaccgggcccggcacctgccccaacgtgcccctgccggtgaacaccacgatgagctgcacgggcgggccgtcgtacatcgtcacccaggacgactacgacgcggcggccccgctgagcggcaccgcccgggtgcaggcccgcgcccccggcgtcccggtccccggcacgtacgacacggccactgccggcgtgccggtcggcagcggcaacgcggccgccgccctggccaccgcggcgctgcgggtgctgcccgccggccaccaggccgccgtcgaggccggtgaccggttcgccgtcgacttcaccgtccgcaacaccggcaccctgaccatgcggaacatcacggtcagcgacgaccgggccgggacggcgacctgtccgggcaccagcctgcggcccgccgcgtcgatgacgtgcaccacgcccacctacacggtgctgcagtccgacatcgaccggggtgaaccgttgaccagcgtcgccaccctgcgcgggcaggccgggaccggtgcggtccagacctacgggacggccggcacctggctggcggtcacccgcggcgtcccctccctcgacgtccgtgtcgtcggcacggtcagcccggcggcacaccgggacgcggccggcgtcggcgacgggctgacatggaccttccaggtggtgaacaacggcaaccagacgttcaccgcgatcgcggccaccggcaccggcacgatcacctgcccgcaggaccggctcaccgtccgcgaaaccatgacctgcacctccgaccgggggcacacggtgacccaggaggaggtggacgccggcaaggcactcggcgcggtggtcacggtgaccgggaccgccccggacggcccgcaccggttcgggccggtcgacggcacggtggcggtggtggcggccgacccccggctggagatcgcgatgacgacccgggtcaccgcccaggccgacatggtcgaagccgaggaggtcgacaccggggtcaccgcgggcgacctgctgcgctacacctacaaggtctacaaccggggcaacgtgacggtcggctcgctcagcgtcgtccacgcccgcgccccgaagatcagttgcgccaccgggtcctcgcccccggcgccggtaccgactgcgtggccgccgacctgtaccgggtgacccaggcggacatcgacgcggccacggcgatcagcgacatcgcgtacgccgacggcatcgtgcccggcgccggccgcacggtgacctccaacaggtcgtcgacgtcggtgccgctgaccgcgccggccccgaaactgaccggcatccagaacgccgtctggaccgacaacgacggcgacggccgcctcggccccggcgacgacgtggtctccaccgtcctggtcacgaacagcggcaacgtcaccctgatcaatgtccgggtgaccggcctgcccgacccggtcacctgccccaccacccagatcccgccgggcgcgtcggtaacctgcacctccggcaggtaccacctcacggcggcgcagatcgccgccggcaaaagaaccccgcaggcgcacatcgccggcgacctgctcgacccgcacgcggacaacgtcaccgcggacgcaccctccacggtggccgtgccggcccgcaaaccgaccccgtcaccgtcgccgtcccgctcgcccggcaccgggcacgcgactccggccccgacccacgtcgctcaaccgggcaccccggcccgtcccggcggcaccttcccgatcaccggccgctccgcggcgctggccttcctgatcggcctcggcctgctcgtagccggcggcggcctgctcttcctcgcccgccaacgccgccccgccctgcacgcccgccgctgacctagctagctagcgttgtgctgccacgcccgccgggcgttgctgcgccgtgtatgcatgcacggcgcctcgccgtgctgcgtgtcggtggcgcgccatgcccgtcacacttcacagggtcgtgcatgctgctggcgcgcgccgtcctgccatgcgcgcacgctgctgactcgcgtggtcggcggcgcttccgtgggtgcacgccgccgatcctcgggacggcggcgcttcgtcgtgagtgcacgccgctgactcgcggggccggtggctcaggcggttcaaaagtccgatctgagtcgtctttcggtcacctccgtagtcggggccgggtgtcagttggtctgggccgttcacgccgtctggtggtcgcccggaacgccggcacgtcgggatgcggacggcgcgggaaccccgtgtttaggcggccacgcagaactcgttgccctccggatcggccatcgtcacatggtggccgtcgaatgtggtcaccacgcgcccgccgatcgcccggaggtcctcgaccttggccaggatgcgtggccaggggtcgccgtacctaccgacgcggacgtcgatgtgcagccggtttttcgcgaccttcggctcgggcacctccaggaaacagagcctcgggccgagcccctccggatcgtgcagccaggcgccgccgcccgcgtcctccgcgggctccccgaaggaggccacccactcctcgcgggtccgaaacgggggcgggggcggctcgtccgcatagccgagagccgccttccagaactcggccaactcctgcgcccgcacacagtcgaacgtcagatccacccgcagtgccatggtcgaacctccctgtcctcaccgactccgtcatcctgctccgggggtacgacaaaaacctgccggcgccgccccgacggtcgcgcggtccgacagcgccggtgacctggcggagctgtctcggcggtgcgcccgggtcggcacggggtcgagctgtcggcaggtgtccggggtcgggggtgaggcgcggcggtgggctccgcccgtacgcaggcgtggttttgatcggtggcggtggcgcggcgcgtcgcctgccgggaccacgtcggggccggcgtgtcgggggtcatccgagccgggcgaggatttccgcggtggtacggatctcgccgaagcggggaagcgtgaccgtgagcgcgtggtggtgctccgtctcggtcatgccggacatcgcgtcggcggcgaagatgaggtcgaagcccagatcggcggcggtccgggcagtggattcgacgcccatcgtggtggcgattccggtcaggatgatcgtggtgatgcggcggtcgcggagcgcttgctcgaggccggtgccggggaaggcgccgatggtgcgcttgacgatctcgaggtcgccggggcgaggggtgaactcggggacgaggccgctgccgggcggctgttcggcgacgccggggcgctcgacgcggaccgggacgaccagtccgccggccgctcgtaccgcgtcggccagggcgagcgaccgcgcgaccacgtcggcgccggagtgcgggcccatgttctgcgacacgatgcgcggcatcaggtcgatggcgatcagggcggtactcggtgcctcgattctcatgcgaggacagtgccacatcgcggcatccgcgccgcggaaaaggtctcggcgcgcgaagtgatggtccggtgatccaccctgtccgggaagtgtcttccgggaggggtgtcagagcggtgacggtcgcgtgtcagaggcgtcggggagattcgcggtgtgacggggtgaccgtcactccgatgatggcgatgcgggaggtgcgcgatgtccgcgacggtggcgaagtggtccggcatggtggcggtggacgacacgaggctggcggtgaccgacaccggtggcgccgggcggccggtggtctatgtgaacgggcagttctccacccagccctactggcggcgggtggtgcgcgagctgggcccgcagtggcggcacatcacctacgacgaacgcgcccgcgggaggtcggagcggtccggggactactcgttcgcggcatggctgcggggcctcgacgcggtgatgaccgcgcgcggggtggcgcggccgctgctggtggcctggtcctacggtgcggtggtggccgcgcactgggcgagtctgcacccggagcggacgtccgggctggtactggtggacggcgcttttccgtacgactggctggacgacgcggtcgagcagcggatccggaagctgttccggcggatcaaccggtgcgcgccggtgctgcggccgttcgggctgttgccgcggatgtcggcggagcagcaggcggagagcaacatcgagctgggccggctgtcccgggtcgcggagctcggtccggtgctggacgggatcaccgtgccggtgcggtatgtggtggcttccgggacttcactcggcagcaagggggacgagcaggagcagatccgcaccagtctggagcaggtgctcgtgcggaacccgaacatcgaggtgagcgccaaggtgccgagcaaccacggcgcgatcctgcgcaggaatgccgcggaggtcgcggcggcggtgcgggaggtcgcggcgtcggcgggcacgacgggccgaggcggatcgatgtttccactatgatccgccgatgatccgtaccgcccgccttctcctccggaccattcgcgacggggccgtgcccgcggtccccgagttcgacgccgagcgtgccctgctcgacaaggggttgtgggagacgcggcgggacgtgctgcgcggggagtgggagtcggcgcgggagctgatcgccgccgccggagacgactgggagctgcgcggtacgcggatcctgtcgctcggtgaactcgccgtggccgacgggcggtggctcgacgcctggcgggaggcgcacccggacgacccggcggccacgctgatgctgtccgcccggatcagggagcaggctcggcaggcccggggatcggcgtcggcggcgcacacgacggcgcagcagttcgccgatttccaccggctgtcggaggagacggccgaggtcgtgcggcgggcgatcgaccttgcggctcccggggacccggtgccgtgggtgcaactgctcggcacgctgtatgccggtccgcggggccgggacggggcgatcgacgaggtgttcgaggagggcaggcggcgcgatccgggcaacttcgatctgcacctgcacatgctcagcctgcggtgccggaagtggtacgggtcgcacgagaggatgttcgcgatcgggcgggaggtggccgagacggcgccggacgggacgaatgtggtgctgctgccactgttcgcgcacttcgagtacgcgatgcaggagtacgggtgggacaagcgctcggcggcggtgctgcgcgactgccggaagtacttccgccggacggaggtgcggcaggaagtggaccggtgcatcgccaagtggcgggccgggacgcccagcatcgggcggctcgggacgtgccggcactgggtggcgctgtattacacgctgaccggacagaggaaggcggcacgagccgcgttcgccgagatcggaaagtatgtggatccggcgcatgcgtgggcgtatttccacccgaaccgggagtacggcttcttccaagggtggcgctgggcgaacggactctgaacgcgggtcgcgccggggcgcaccagcggcacgcttgctcagcacacccatggcagccgaccgcagctcgccgagcatccgccgcccgcgagcagactttcggcaggcgctgcgccgatatctggatcaggcggatttcagctcggcggacgacagcagccgcgcaaggcgaccgctgtgtcgccgtccccgcccagctcaccgggtcacgccgcgacttcgacgccggccaagcacggcctggctggacagcacacctagcgggcggccggctgcagagtcagggcggtgaccaggcggttgatctgggcgcggatctccgggacggcggtcgcctcccaggatcggccgcggcggagcgggccggccagccacaagccggggcggatccggccgatcgcgtcgtacacgcggccgtccgggtcggtgtcgacgcccaagccgtgcggggcggtgcggatgccgccgccccggaacagggcggcgagcagcgggttcgccgtggcggagccgggcaggcggcccggtccggtacagctgatcaccgcggcgaagtggcgcggaccggcggtggtggtcacggtcaggccgccggccggatccgggctgatggcggtgacccggccggtggtgaaacgcagccggtcccggcggcgcaggtcggcgatcttcgcggccaccggcggggccatgcggtggcggtggatgtcccagtagcggaccacgtggcggaggaaacggtcccggtccgcttcggtgaagctgtcccagatctcgtcggcgtgatgacgcaactcgtcgaccacggcgatccagtcggcgccggcgtcaaccgtggcgcggacctggcgcagcaaccggcgcagggtgagatcggcgggcaggtcgaggcggacttgggccggggcgttcaccgggtgggcctgggggagcaggccgtgccgggagatcgactcgatcgggccgcggtggccggcggcgtccagggtgagcgccacgtcgacggcggtcagaccggaaccgatcagcaggatcggtgcgtcggagggcagctccgggcgcggggcccacgggtcggtgatgaatagcggatgggagtacgccgcgtcgtcgatccccgggagccgggccgcgggcggattgccgacggcgaggatgacctggtcggcgcggaccgggccggtatcggtcacgatcacgtagccgccgtgctcccggtgcagcgcggtcgcggtggcgcggtggtgacgcagccggccggccgactcgaggaccgtttcggtgaaccgctcggccaggtagtcgccgtagaccgagcgcggcaggaactcgcacggctgggtggggcggccccgcgcggtgcaccagcggaccaggtccagcgggtcgtcgaagtcggcggtcatcgagcccgcccgggcgttcagaatgtgccacggctcggccgcgccgtaggcgacaccccgcccggcgacctcgtccggggcgatcagcaccacgtcctggtgggtgcggcggatcagggcgcgggcgagcagcgcaccggtggcgccgccgccgacgatggcgacggtgcggccggtggcggcgtcccgcctagcgggcttggtgacttcgacgaggctcgacatttcactctcccgcaggtcgacggctgaacaagcaaaccacaaaacccacctgttttgtagggtaaggcggtgtctgtcacgcagttttagcggccggttcacaaaacgggtggctcgggcgcggcgaccgattatgaacgccgccgcgatccggccgtcagctggaccgtgacggccgggaatcgcatccggggaaggaagcccggcccgaaagccccggcgacgcgaagaagccgggcccgcggatccccggcggagactgagcgaccgcggtgtgctccctgcctgtggtgtcagaccgcggtgaagaggaccgacacgttctgaccgccgaagccgaaggagttgcagatggcggcccgcaggtcggtccggcgcggctcgccggcgaccacgtccagcttcacctcgggcgacttgttctccaggttcagggtggcggggatgacgccgtcccggatcgagagcagggtgatgatgctctcgacggcgccggccgcgccgaccaggtggccgaaggcggacttgggggcggtgaggaccacgtcgtcggtgagcgcggcctggatcgccgtggcctcgccgacgtcaccgaccaccgtcgaggtggcatggcagttgacgtggtcgatgtcggccggggtgaggtcggcggtgcgcagcgcgttgcggatggcgcggatctgaccgctgccggtcgggtcgggaccggtgatgtggtgggcgtccgaggtgacgccgtagccggcgaggcgccccaggacggtggcgccgcgggcggccgcgaagtcggcccgctccaggatcagcacgccggcgccctcgccgagcacgaagccgtcccggtcggtgtcgaacgggcgggacgcgcgctccgggtcgtcgttgcgccgggacagggtgcgggcctgggcgaacccggcgatcgtcagtggcgcgatgcacgcctcggcaccgccggcgatgaccacgtcggcctcgccggcgcggatcagccgggcgcccagggccagggcttcggcgccggacgcgcaggcggaaaccgtcgcgtacgccccggctttcgccccgaactcgatgctcacccagccggccggaccgttcggcatcatcatcgggacgaccaagggggaaaccttggacgggcccttctcctcgatcaggtcgtcctggccgaggatggtgccgacgccgccgatgccgctgccgatcaccgcggccagccgctcgccctcgacctcgggcgcgccggcgtgctgccacgcctcgttggcggcgaccagcgcggcctgctcgcaccggtccagccggcgggcctggacgcggggcagcaccccggccgggtcgacggccatcggggcgccgatcagggtgggcagatcggcccaatgccgatagttctgcacccggtcgtcgatgcggcgcgcgccggagcggcccgccaacatgccctcccagagggtgtccacgtccccgcccagcggcgtggtggccccccatccggtgatcacgacgtcgatgtcactcatcggcttcccctatccgctgcggcgacttgccttccatagttgtatcgcatacaaatttggtgtgtccaccgcagaaccggtccgagcccgcggacggcagacccgcacggcgatcctggagagcgccgcggagctgttcgccggccgcggcgacctggccgcggtgagcgtcgcggagatcgccacggccgccaaagcccacccgaaccagatcacctactacttcggatccaaggacgcgctcttcgtccaggccgcgtttcgcctgctcctgcgcgacgcggtgcgcctggagccggtcggcatgcgccagcgcaccccggcctcgttccggatcgccctggcccgcacggccctggccctgcccaccgtgccgctcgcggtccaggcgatggcgatcagccggatgcggtccgaacttcatgtgcaggcacagcagagtttgactgtcctcttccgccaggccgagggctacctgcggcgcatcctgcaccgccgcgactggatcaccgaccgcccgctcgacatcgaggcgcgcaccttctggatcgccgtcttcggcgcccgcctcgtctcggagagcggcttcggcggccagtccgccgacgtcgacctcgccggcgtcctcaccgtccgccagcgatgatggacgctggcggcctgctcccaggttgctgggggcggcgccaccgccggtccactaccaccgtgatcatgccggccgggtcttggcgagcgccctgccgctgaacgcctcggcggtggccgccgattacgactatccgacatccgacatcgatgatgtgcctctcttgcagatcaatggcgatggtgtacgggcccgccgcctcgacagtgccgacctgacgtccgtcgggctttcaccgtccaccggctcgtccccggtggagatcgcttcggctcgggtgggcacctggtcgccgacccggtcacggtgtcgtctcaccacgacaagcagcggttgctgaccgcgatggccggtgggggctgcgttccgggaaggtcggggtgccggggcgggtcgtgctgagtgcgggggatttcgccgactgcatcgggctgtccatgctttcgcctggtcgaggtggggctgtccggaatttgggcgggccgggaatactggttccggcgtccgggatggccgggggccgaaaaagggggacaagctgatgacgcacggggcggagccgaacgacgggaccggcagggagacgccggtgccgccggagggcggcggccgcccggtggccgggtcggcgcgggttcccggaccacggccggccgacgacgatgtccacaccggtcagtcgccgccggggcgggccgcggtgccggcggcggggcagtctgccggcccggcgcttccgcagaggcatcaggggtttgcggggcaggcgcagtcgtacgggcagccgcttccgcaacggcatacgcccgagcagcagcagttccccgggcagtcgttctcgccggggtcggcgccggggcagccgcttccacagcggcgcgtgcccccgggatcgtcgcaggggcaggcctttccgcaaggacaggcgcccggcgaggcgcagggacgggtgtcgggcgaggcgcagggacgggtgtcgggcgaggcgcaccggtcagggccgccgcaggggccggggttcgcgccggcccagggatccgggtcggcgcaagggccgggacgggcggctgtgccggggccggctccgcagggtgcgccgaatccgttgttcgggcccgggccggcgacgccacccggctagctagctagcgggcagtcgagcgccggctgggcgagcggcggcagccagtcgggcgcaggtcaaggcgcaggtcaaggcgcaggtcaaggcgcaggtcaaggcgggagccaggaccggaaccgagcgggcctaggcgcgggcgggggccttcacggcgtaccggcaaatgggcggtccgacaaccgcgtaccggcaaatgggcggtccgacaacgacgtaccgcaaggaaagggccggcggaagcggcgtccagccgccctgctcatcgcggtcttcctgctgatcgcgctggccggttccggtgccgccgtgcagctcacccgcgccctgccggacgccaccctgaccacccggatcgccgagacgatcaaggtgcccgggacgctcccgaagtttccgtggccggcgcagggatcggccgagctgatggtgcaggggttgggccggatcggtggctcgggcgggcagaaggccgagccgatcggcagcgtcgccaaggtgatgaccgcttatgtcatcctcaaggaccatccgctggacggcaccgacgaggggccggcgctgaccgtaaccgctgctgacgtggcggactacaacgcccggatcccggggggccaatcgctggtcaaggtggtggccggggagaaactgagtgagcgggacgcccttgaggcgctgatgctgccgtcggcgaacaacatcgcgcatcagctcgcggtctgggacggcgggaccgtgaacggcttcctggagaggatgaacgacgccgccaaggacctcgggatgtccgataccgattacacggatccgagcgggttcctgcccaccacgaccagcaccgcggccgatcaggtgaagctggcgcaggcagtgttgaagttcgatgtgttcgcccagatcgtggagttgcgcagcgcgcagattccggtggtgggaacgatccagaattacaacgcgctgctcggggtggacggcgttttcgggatcaagaccgggtcgacggatcaggccggtgggaacctggtgttcgcggcgcggctgccggtcggatcgcggacgctggtggtggtcggcgcggtcttcaaccagccgggggcgaacacgccggagcagctcgcggcggtcaaccgggtggtccgcaagctgctcgcccaggtgcgtcggacggtcaaggagtatcagctgctcgcggcgcaggcggtcggcaaggtgacgaccgcctggggtgccgaggcgacggtgacgccggccggcccgctcaaggtgctgggctggcccggcctcgcgattccggtgcggaccacggtcacgaaaccggggccgcgggtcactgccgggcagccggtgggccaggttcaggcttcgggcgtacgcgtcgatctccgggccgacgcggcgacgagtgacccctcgctgtggtggaagctcacccggaaaccgtgacgggtccgctgggtggcgaccacgcagcccagcacgatcacggccgccccgatcgaggtggcggtcaccggctcgcccagcagcagcgccgaccagatcagggtcagcaccggctgggcgagctggatctgcccgaccgtggcgatgccgccccgggccaggcccgcgtaccaggcgaagaagccgaggaacatcgacaccacggtgaggtagccgaaggcgacccagccggccgggccggtgtgcggcgggtgccgcagagcggtgaccacggtgatcggcagggtggccggcagcgcgatcagcagcgcccagcagatggtgcgggcaccgccgaggtcgcgggcgagtgcaccgccttcggcatagccgagcccgcacagcacgaccgcggccagcaggtacaggtcggccggggtgagcgcgccgtgcaccgtgccggtggtggccaggaagccgaggacggcgatgaggccgccaccgctggccagccagaacaccaggggtggacgttcctgggcgcgcagcgccgcgaagatcgcggtgagtgccgggagcacggtgaccaccaccgcgccgtgggccgaggtctggctggtcagggccagtgaggtgaacagcgggaagccgacgacgacgccgagcgcgacgaccggcagccgccgccactgggccggggtgggtcggggcgcccgggtgaccgtcaggtaggcgacggccagtgcggcggcgccgaccgcgcggccgaacgcgacgaaccacgggtccaggtcgtgcacggcgagtcgggtggacggcagcgacatgctgaacgccagcacgcccagtgccccgagggcatacccggctgttaccgtgccgcgggcagtagcgctactctcttctctcatgaatgacggtaacgcagcgacccgcgttatccaagatcttcgggatcgggcggcggccgccgcgcccgggacgcggctgccgtcggtgcgcgagctgaccgcccggcacggcgcctccccggtcaccgtggccgaggcgatccgggtcctgaccggtcagggcgtgctcgagacccggccgggacggggcacgttcgtggccgagcggccccgcgcgccgcacccgcccgacctgtcctggcagacggtggcactcggcccggcccgcgccggtgaggacgacatgcgggcgttactgtccctgccgccggccggcgcgatcccgctcaccggcggctacctggaggccgagctgcagccggtcgccgcgctgggcgctagctagctaggttggaaccgaaagggttttgaaattcaaaaccccttttcggttccaacctgccagccgctgtatgcgaacccgaccggggccacgctcggcggggaccggcgggccgcggtgatggacgcggtccgggacgccggggcgttcctgatcgaggacgactacgcgcgggacctgacgatcgacggggacccgccggcgccgctggccgccgccgacccggacgggcacgtggtctacctgcggtcgctgaccaagtcggcggcgccggggctgcggatcgcggcgatcggggcgcgcgggccggccggcgcccggctgcgggcggcccggctgctcgacgacttcttcgtggcgggcccggtgcagcaggcggcactggacttcgtcaccggcccggggtgggtgcgccacctccgtacgctccgatcggatctggaaagccggcgggcggcgctggtgcgcgccctggagcggcacctgcccgagctggcgccggccgtgctgccgcgcggtggcctgcacctgtgggttcgtctgccggacggctgcgacgacgtcgcggtcactgccgcggccgccgccgagggcgtcgtcgtgttccccggccgcccctggttcccggccgaggcgcccgcgccgcaccttcggctcacctacgccgcggccccaccggacctgatggacgcggccgtccgtcgattggccagggcgtttccgcgatgacacgccggtagggtgacggacggaccgggaccagcccctacgatgcgcgcgtgcaatctgatttcggcccccgggccggcatgcgactgggcgatcggtaccgcctgcaggaccggctcggcgccggcgggatgggcgaggtgtggcgcgccctggacgagtccctgaaccggctcgtcgcgatcaagatgatgctgccttcggcagctcaagacccggatttcgtacgtcgtttcgccgccgaggcgatggccatggccagggtcaaccacccggccgtggcgaccgtccacgacgtgcggcaggcgcacgggctgaccttcctggtgatggagtacgtcgacggcgaatcgctggcccagcggctggcccgcgaggggcggctcagcccggcggagacgatgcggatcgtcacccgggccgccgagggcctgcaggccgtgcacgaccaggacatcctgcaccgcgacatcaagccggccaacatcatgctgcgccgcgacggcgaagtgctgatcaccgacttcgggatcgcccggcatgccggcgccgccgggctgaccgcgaccggggcggtgctcggcacgcccagctacctgtcgccggagcaggtgctcgggcagccgtccgaccggcgcagtgacgtgtactcactgggcctggtcgcctacgagtgcctcgccggggagaaaccgttcgccggcgacaacccgtacgcggtggcactgcaacgcgtccggcacgagccccggacgattgggggcgggcgtgccggggccggtactcgccctggtcgagcgcgcgctgcagaccgacccggaacgtcgcttcccgtcggcgctgtcgatggccgaggcggcccggcaggtggacacggcggccgctgacccgcgtaccgccagccggcggttgtcgaaccgtgccctcgtcgcggcggccgtggcggtcgtggtcgtcgtcgcgctcggggccgcgttcctgccccgcggtgggcacgggaaaccggagccggcggctgccgagccggccgccggcgccctgccggacggcttcgcggcctgcggcgccgggatctgcccggcccagccgatgtgctggagcgggctgacgcagatcggggcccaggcgttgccgccggcggtggcgtattgcccgggcacccacgtgtgggagacgttcgcggtgctccggctgccggccgggccaccggtgatgagcgcggacgcgccgttgatcgagcaggccgacgtggcgaaggcctgctcggcggcggaactggcggcgcacagcatcgacccgggcaggacccggggctggcggcgcgacgcctggccggtgcagtcgggcaccgggtggctgctgcactgcatggcgcagccgaagaccgggtcgtcggtgggggccgcgttccgggcgtgatgcgggtgcctatttaagatcatcggcatggcatgtcgcggggtgtggttcgcactgaccgggtcgcaggatcgggagctcgtcgaggctcccggcgacgcggaggtgcgggcgctggtcaccgacctggaggcggcctgggactgggatttcctgtgcgaggcggacaaggcctgggacgccctgcaccggtgcctgggggacgggacgctgcggttcggcaagcatggcggggtactggcactgaccgtgctgggcggcgggctgcaccacgacgggccggactacatcgtggcgcgggtgcgggccgatcaggtgccggcggtcgccgcggccctggcggcggtggacgagagctggctgcgggagcggtacgacgagatcgacccggaggactaccagggggtgctcgacgacgaggacttccggtacacctggcagtacctgcaggacgcgcgggagttctaccggcgggcggccgacgccggccgttcggtgatcttcacggtggatcagtgacccggtaattattgacattcttggatgcggcgacctactttcgtccgaggaaagcgcttacctggttgttggggccccatcgttgcccattccgttcccccgacggaggaatccccatgtccccatcacgtcgtaccttcctggccgccaccacggccggcgtcctcaccgccggcggcgcactcggcgtcagcccgctcagcgcggccgccgccgagtccagcccggtcgggttcgccagcctcaacggcggcaccgcgggcggctcgtcgagcaccgtcgtcacggtgaccagcgcctcggcgctcaagtcggcgctgagctcgggcacctcgcagaccgtccggatctccgggctgatcacgatctccggcatgtaccgcgtcgcctcgcacaagacgatcatcggcgtcggcgcgagcagcggcgtcaccggcggcggcttcaccctcaacggcgtcaagaacgtgatcatccgcaacctggtgttcaagaacgccggcgacgactcgatcaacctgcaggacggcaccaccaacgtgtggatcgaccacaacgacctgtccaacggttacgacggcctgatcgacatcaaacgcggctcggacttcgtcaccgtctcctggaaccacctgcaccaccacgacaagtcgatgctgctcggacacagcgacgacaacggcgcccaggacaccgggcacctgcgcgtcacctacgtccacaactggttcgacggaaccaaccagcggcacccgcgggtccggttcgccaacccggtgcacgtgctgaacaactactacagcaacatcggcgcgtacggggtggcctccaccgagaacgccggagtcttcgtcgaacgcaactatttcgagaacgtcgaccatcccacggtcacccagaccggcgactcggatcccggcaacctcaaggtgctgaacaactaccgggtcaactcggggaccgaggaggtccgcaacggcggcagtgtcgcggccatcccgtacccctacacgcccgaggccaacagctcggtcaaagccaccgtggtggccggggcgggcaccggcaagatctgatcgctcgtcgcatccgacggcgtccgccccatccccgggcgggcgccgtcgcccttttccggtcgcttctcggaggtctccccgtgtcccactcccgcatcgtcgccggcgccgtcgcggtgtccgtcgtcctcaccccggtcgccgcccgcgcggcgacctcgttcaccgtcgccgcggacggatccggcgactacaccaccatccaggccgcggtcgcggcgtcgtccgccggtggagtgatcaccatcaaggccggcacctatcaggggcaggtgcagatcccggcgtcgaagtccgggatcaccctgcagggtgcgaccggcatctccgctgatgtgatcatcaccgggaacaagccgcagtccaccgccgggacggctggcagcgccaccgtccacaacctcgcaccgaacagcacgatcaagggcctgaccatgcagaacacgtacggggcggggagccaggcgctggcgctgtacgctgcgggcgaccggcaggtctatcggaacgtgcagctcaagggataccaggacacgttcctgtcgtggggtgggaccggcagctcacagatacgccaatacatctataagtcttatatttcgggcgcggtggatttcctttacggcaacggcgcggttgtcatcgacagcaccaccatcgagtcgctcaacatcggcagcagcgcgaacaacggatacatcaccgcggcggcgaccgacgacagcaacgcctacggcttcctgatcacccggtcggtgctgaaaagcaccgcggcgccgcagaccgtggcgctcggcagatgctggcacgcgggcggggcggccgacgcgatcggacaggtgctggtgcgggactcgagcctcggctcgcacatccggcaggccggggcctggcaggacatgggcggcttctcgtggaggacgtgccggttcaccgaatacgccgacagcggggccggggtgagcaccggaaccggcgaccggccgcagctcagcgcggcttccgcggcgaactgcaccgcacggaggtatctcgccgggagcgacggctggaatccggtccagtagtgccgcggcgtgccccgaacgggtgaaggatcgtgccgcacggccggtcggggagttgggtcaaggcccggctcgtcgccggccgtgtaatgtatcggcgaacatcgatgttctactggtggggggacgatgctgaaccgacgggtgaccaacctggtcctgaccgcgactctggcggcggccggactgatggccgtgcccgggcctgcgcccgcggcaaccgcgatccccgggcccgtgcccgccggacccgcgctcgccgcagtgcccgccgctgcgagtccggtgatcgcggcgccggcagccttggattcctcccggcgcgtgggcgtcttcgcggagctttatcgcggccggctcatccatggctggggtggcgctcaaccgtgtgcctacatcgacggggtgtccctgggcctggtgagtcacggcgacaaccgttacagcagcacggtcaacgcctacgaggtcaccgtcggggtccgcgagaccacccgcgccgcggtgcgcagcctggccggcgacgagctgcagccgaccgagccgccggcctactgctcgcggtgaccggagtgctcggccggcgccggtcagggccgtccgcccgatcatccgcgccgatcgagcggtaatcgggcgccttgcctgttccggtgctggtgtggcttccgcaagccgtgtggcttccgcaagccgtgtggcttccgcaagccgtgtggcttccgcaagccgtgtggcttccgcaagcggtgtggcttcgtccgcgctcgcgccgtgctcggccaggggctccgcaagccgtgtggcttccgcaagcggtgcggcttccgcaagcggtgcggcctccacaagcggtggcctccgccaggcgcgcgacggcgcctggcggaggccacggcctccccagaagcggagggttgtgcgttcagccgcggggcttccccgggtgagcgcccgttgaccggtcgccgtcgcccgaggtgctgcccttcgatgagtcgcgcggcccccgccaagtcgcgcggcccccgccgctggttcgctgtcaggcgtaggtgtagacgccgctgtggtcgagaacggaggccggggttacgcccgtccatggctgcagggtctcgtcgaggtcgacgacaccgctggtgccggcggccggcaggtagtgggcggcgtcgaagccccaccgggtctgccactgcgaccacaggcggtcgatgttgcagtggtgcagccagaatgccgggtcgttcggcgaatcctgctgacccatgtggccaccgacccacacgtggaccgcgttgtgcaggttcggggtggtccagccttccatgcggttgcgcatgccgctggtcgaggaactgttccacggggccgcgtcgtaggtgccgacgccgaggaccgaactgacctgggcggcggtgggcagcgagttgctgcccatggcgcgccgcagggacgtcgcggtggtgctgctgacggtgatccgccagttggtcgcgccggcgaacgggccggtggtgaccgggccgttgccgccggagccgttgccgcccaggaagtcggcggtgaacggggcgccggtggtgctgcggtccaccgtccagtcccagtagggcagggtcaccgacggctcgtacacctgcagcgcccgctcgaactcgatcaggtactgccggtgccagggcaggaacgacggcgactggtgggcgtagcggacgcccccgacggcggcgaaatagttcaggtgggtggtgacataccagtcgtagttacggcccgtggtctgtgccttcaggcgcttgacggcggagacgaacgccgccttctcggtgctggtgaggttgcgtgcgttcttgcggacgcccatgacaggggtgagcctttcgatcgatcgggaacggggcgggtacggtcagttcccgtggttgtggtccgcgccggccagggcggtgagctcgctgtcacccagcgcgtcgaccgcccgccgggtgagcttgagcaggccgtcccggttcttgtcggtgtcgatcaggaccggctcgtagtggttgagggcgctgatgaagccgagcgtgaccccgccgccggcggccggcagctcgatctgcatgacggccagcctgcgcccgttgatgtgcacctggtgcggctgccggctgcccgacacgctgcgcagcgcgcccggagtgtcggcgccgtgcactccggtgatccgcttgccgcggtactccacgtcgaagtcgcgcgggtcggccgacgtccgggcgccggccggcgcctgggcggacgagctggaggtggacagggcctgcgccccggcgacgccgccggtgacgacggtggccgcggccgcgtatcggagaacgtcccgacggctcagggtggacatggtgtcgatgcctcttccgttggatctcccggcgcccgtgagggcgccgggagaaattgatcgatgctaattaattgcttttccgggagccggaaaaatggccgcgcggcggccgccccgctcgaaaggcgtggcccggagaatggcggctggcgcgtcgcgcgccggaaaggacggaaaggtcagcgaacgtagagggtgtagctcggcacgaagccggtctggcaccggaacgacacccacacgtggcgggcgacgccgtccgcgccgaccttgcggcactcggcctgcgcgtcggcgacctcgttgaaggcggccgtgtagacgagcttttcgctggcccgcggcgtggtgcgcggcgtgaacgtgacggtcaggtcgtcaccggcgaagccgctgcgcacgacgggcgcgcgccacacgccggcggccgtcccggcgtcaccgatcaccgcggcgcgcccgaaaccgtaggtgccgagcagggcggtggtggtggcgggcgcggcctgggccgcggcgggggcgagcagggcggtcgcggtggcgacgagggcagcgacagagagcttgcgcattttctgggtttcctttgcattcatcccggggatcttcccgtggcatcgcacgtggaccgaaagattttctcctccggcgcgccgcgaccatatcaccattccaaagaggatcgatgtggatggcgtcacactgtcggaataactattccgacgtaattaacgattgttaagtcgagggcgtcgacgaaaagccagaaagccgtcccatcggttgaaagcgacattcttggcggcgctccacgggccgggacggtagaaagtgagcatgctcatctatctggactgcgacaccggtatcgacgacgcgctcgccatcgcctatctgctcgggcacccggacgtcacgctggccggcatcggcacggtcaacgggaacaccaccgcaccccaggcggcggcgaacacgctggggctgctggcgctcgccggccgggacgacatcccggtcgcggtgggcagcggcgcgcatccgtacgcggtggcctcggtgcacggcgggaacgggatcggcggagtccgggtgcccgcggggcgcgagcccgacccgcgtaccgccgcaacgcttctgatcgatctcgcccggcggcatcccgggcagttgcacctgctggcgaccggaccgtgcgggaatctggcggcagcactggccgccgagccggacctgccgtcgctgatcgcctcggtgaccgtgatgggcggggcggtgcgggtgcccggcaaccggacaccacgcggcgaggcgaacatcatccacgatccggccgcggcggccgccgtgctggcggcggactggccggtgacgctggtgccgctcgacgtcacgatggcgcaccgatggtcgaccggcgacgtggcgtcgctgcgggccaccgggtcaccattgcacgtggcgctcgcggacatgctgcccgcctatttcgacggctacgccgagcagctcggcgtccgggagatcccgctgcacgacccgctggccgcggcgatcctgctgggcgaggtgacgccggccgacgcgccacggctgtcgatcgccgtcggtccggacgggcacaccgtggagacaggtcccggccccgtccgcgtcgtcctgaccctgaccgcccccgccgccccggccctgctccaccggatagccggctgaccgcccgccgcccccggcccggctccgctggttgaccgcccgccgcgcccggcccggctccgctggttgaccgcccgcagcccgtcccgggtgtgggcggactgtcgccggttttcccgcggctatgccgcgaccagtcgccggtttccccgtgaattcgccccgatcagttgccgatgccctggtagccgcgcagctgccggcgccagaaccggtacgccagggtgaacagcccggcgccgaccagcggggacaggtagccgagccaggccgggacggcgagcccaccggtcgagtcgaggatgacccccgcggggaggaaggcgatgaaggcgaccggcagtacgtaggtcagcaggcgctgcaccccgccgccgaagacgctcagcgggtacgacccgagggtgtcgatcgcatcgaataccagcatccggtacgcccaggtgtcgagcacccgcaccgacagcccggcgaccgttaccaccgccgacgcctccagcagggccccgccgaggatcgccagtaccaggaacgccaccgagccgggcgaccagtccacgggggtgacggtgagcgccaccccgaacagcacgatcgccatcgacaggtcaccgaacggcagcaccgaccgggtgtacgaggcgagctggaccagcgggttcgccgggcgcagcagcatccggtcgagcaggccttcgcggatcgcgctgtcacactgcccgaccccgtccatggtgatgagccacagcgcgtgcgacagcagccgcatgccgtacaggaaggcgatctgccccagaccccagccgcccaccgtgtcgaaggtgtgcagcagcgcccacacgaacgcgaaaccgctgccctggtaggcggcgccggccagcagcatccacaccaggttgccgcggtattgcaggacgccgcgcagcgcggcaccccgcaacatcaggtagatccgcaactcacggcgcaacccggtcaccgttcaccacgatgtccggtacggccggcgcggctcagccaccgtgcaccacgaccttccggtatgcgcggcgccacaccaccgcgacgaggacgcccaggaccgcgatccaggccagtgcgacggcgaacccgcggagggccgccgtcccgccgcggtgaccgatgtagatggcggccggctcgtacacgatgaatcggaaaggcagcgcctcggcgaacgcccgcagcggtccgggcaggaaggtcagcggcacactggcaccggccaggaaggcggcgatgaagcggtagagcaccgcgatccccagattgtcgacggtccagaacgcggtcatcccgaccaccatcgtgagcagcgcgttcatcacccagccgagcagcagcgccaccgggtagagcagcccggcggtcaccccggccggccgggacagcccaccgagcagcccggcgaccggtgcggcgatcaccatcgcggcggtctggatcaccgactgaccggcctgcatggcgagcatctgccccggatagcccagtggccggccgacgtcgaagacgacctccccggttcgcacccggttcgccatgatccaggtgatcggcgagttgatgatcatggcctgcaggttggccagggtcaggtagacgacggtggcctgcagcgtgagcccggcgaccacctcgcgcccccggtacgccgccgaccagacccgggtgaccagcacgatccacatcagggtcaccgcgatcgaggcgaacagcgtgctgcggtattgcagacggatcgcgattgccgtccgcacatacgccccgtaggcccgggcggcccgccgcgcatgcatcccgtagccaccggccgcccgtcgcaccatggcgttcaaggtcatgcctcgcgcctctcgcggtacagctcgcggacgacactctccaggttggactcgacgacggacaggtcgcggatctgccgcccgtccccggccgcggtcagcagccggtggaccggctcgtcccggcccacccggaaccgccaccgcccgtcatgctcgcgctcgccgacgaatccggccaggacgagccggtcgccgtcgggctggtcgccgtcgagccggacgagcacatcctggtagggcgcgtaccgggcgatcagcccgtccaccggtccgtcgtagagcacccgcccgtgatcgatgagcaggatccgccggcacagccgttccacgtcggcgaggtcatgcgtggtcagcagcacggtcgtgcgcccgctgcgattcgcctcgttgacgaacccgcgcaccgtctccttggccagcacgtccagccccacggtcggctcgtcgaggtagagcaccggcgggtcgtagagcagggcggcggccaggtcgccccgcatccgctgacccaggctgagctgccggaccggcgtctgcaggaacgggtcgagctccagcagctcgcgcagccgggccaggttgctgcgataccgctcggcgggcacgtcatacagtgccccgatcagccggaacgactcgatcagcggcaggtcccaccacaactggctacgctgcccgaacaccacgccgatccggtgcgccagccgcttgcggtcgcgccacggcaccaccgcccgtccgccccggccacctccactgtcccgccggtcggccagagcacccccgtgagcagtttgatcgtggtcgacttgccggccccgttgggcccgagatagccgacgatctcgccctcgtcgatgctgaagtcgatgtggtcgacggcgaccgtccgctccttctcccgggtgaacagtgtccgcaccgccccgaaccggccctccaccggtttcgtccgcaggtactccttggtcagctgccggacggtgatgagggccatgcccaccggtctaccgattgggtcgaatccgggtcaaccggattcccgtccggccatcatcggaggtatgaacgtgatcgacgccgtgtggaagcgagcctgcgcccacgagggtggcggccccggcgaccgccacctgtccgcactcctgctgatccacggccggatgctgactggcggtgccgccgagaccgccgtcggcttcgagccggaggaactcgacgccgccgtggaagcctgcgaatacttcggcctcaacggcctggccgccctgttccgcgagatcccggcggcgctggactcggcatacgacgaacgccgcctgaacgagatgttccgcgacatggacccggagggactgatggtgcccgccgccttcgaggatcgctacgaagccaccccggaagatttcgacccgccaccccgccgccgttttcacctccccacccactgaggacgcgctgcccgccccgcctcccaccggcgtcgcgccgattcggcatcatggggccggtgacgacgatccgctcgttccgccccgccgacgcggccgctgtcgccgcgctgatcgcccgttgcctgcgggaggtgaacagccgcgactacccgcccgacctcatcgaccggatgtgcgcccatttcaccccggaacgcatgatcgagctgtccggcatccgcgagatcttcgtggccaccagcaccgcgagggcggccgaacccctgtcggagtcaccgccgcgcccggactcgcgaccggccccggagccgcacgcgccgcccgcctccgagtcggtcttccggcctgccgcggagccggcttccggaacggtcctgggtaccgtgtcgcgggacggcaacaaggtcttcacgatgttcgttgacccgcgggcgcacgggcagggcatcggccggaagctgatgacgcacatcgagggtctggctgaggctgacggcttcgatcacatggagaccggtgcgagcatcagcgcgcacgacttctaccgccggctcggctactccgatgtgcgtgtcagcgagaccgatttcggcctcaactacatcctgcgcaaaccgctcgcatgacctcctcccagttctccgtccaccagcgcaggaatcgcccgcgcgccgtgaagagccggtcgcaggtgctgtcaccgtcgtcatgatgacgctggagctgccacgtttcggtagccagcgtccaccggcgccgctcggccgcatcgatcacggcggcccgggtgagcggaagacgcgcacagtacccacgaatcagcgcggtggtgcggtccaggtccagggccgtgcgtccgccgtcgctgaacaggatggtggcggtgcggaccacctcctgtgcgtagggacggacccccatccgatcccagtccaggatcccggtgacccgcccgcccgccatgagcaggttgaaggactgcaggtccccgtgcgtccacccgcacggcccgacccgccccggcgcgggtcgccggtcggcgatggcgtccagcagcacgagccgccggtcgatctccccggcgagatcctcctggtgcgtcatccgcgcggggtgcgccgttcgccgatggagtgcggcgtagtggcggagggcggctcgggcctcgtcgaccgatgccggggtgtcggccaggtgggtgggggccgcgggcagcaggtcgcccagggtgaggtggagacgggcgatcaacccgcccagcccggcgcaggcgtccaggggcagggcggcgcccgaggggtgttccccggggcgccagtcgctcaccgcgtaccggtaattattgatcttgagtagggcggagccctcgggggtgcgccgcgcgagcgggaccgggaaaccgcgctcagcgagcctcggcaggagattctggatgtcctcgaactcttccggtgaccggtcggtgagccgcttgacggcgaactcgcccctatcagtggtcaggcgccaggtgagattcatgaagccggtggtcacgacacggcacgcgaccacccggcccagcccgaaggcgtcggcgatcccggcgggcatcccggacgactccacttccggatccttccgcggtgggtgatggcgacagccggcggcggctgccccgtggaggagcgatccgggccgcgtcgatgtcgtggcgggggcgggcccggagccatacgttatggagttgtcaaactagctgcgctggcgcaggtcgtgggcggcgatcacccgctcggtcgggtcgccgctgcagggtgtccgcaggcgatcggtcagcaggaagtcgggcaggcggaacgtctccgcgtgctgggcctcggtgagcggaaaggtcccgccgcgccgctccggttgccagccggcggtcagcgcgtagacgatcatcgcccggatgtcggccggccccgggtgcgaaccgtccgtcgagcacgccgaccagggcgtgccccaggcaaccgacaacaggtcggcctgcagcgcctgtccgttctttcccgcgccccacgcccggacccggatgcaccggtgacagtccgcactgccgggcacgtggtggatctccgctcgccaggtgaagatgcgcgagccgtgccgaagatgccgaagtcgaagtcgcatgtgcctcacctctggcatcgatcctgccacagcgccacctccccgaacaccaggcagacccggccgggacagcccgtaggcggtaaccgtccacgatgaacaaagtcgacggatatcaatccggtatcggacatgtctgcgggaatccggattccggccgttacgctcggctcgtccaacggctcggcattcagggaaaacgatgtccggcaccggcgtggccgccatgatggtcgccgtcctgctcctctccgcctgcgctgaacaggcacaacgcaccgtttcccgcgcctcgccgcaggcaccgggatgcgggcacgacgcgccggtcccggacggcgtgacgctcctcgccgaggacgtctgggcaggcggcggcacgacggcgagccggctgcgggtgctgcccgccgaggcgtgctccgggaccgcgcggcgccccgaggagtgcgacacgttcccgtgggcaccggagcgcggtctctacccgctcggcggccgcgcctggctctccgtcggcatggcgaagaacgggaacgacaaggccgatccggtacgcgaagagctgctgttgtacgcccccggctcgcacttcgcgcagacgtccgcgcaagccgccctggactgtggcttcacggtcctgaccgtgctcgacggcaagccggccaccctgcagcgcatcggcgaccggctgaccgagatcgtctacatcaccccgcggtcggtgatcgggatgtccagcgtcgatccgtcggtcggcccggccgatctggtgtggctcgcgggcgtcgccgccgaccggtccgcggcgctgacgtacgcctcctgattttgtcgtaccccgtcgctaccgttcggccatcttcttacggagcactgggcgaagggtggctgtgatgcctgccgacacgacgtacctcgaactttccgaggacaccgggagcgcgcacaagttctacgaggtcaccgtggacggcaccgacctgaccgtccgatacggccggatcggcgaccgcggccaggtcaagcagtcctcgttcaccaccccggagaaggcgaaggccgaggcctcgaagaagatcggggagaaggtgcgcaagggctatgccccggcggtcgccggcggccgggcccgacgggccgtctcgcgccggcagatcgtcagcacccggtccaccgccacccgcgcgccgatcctctggcgatatgcgtcgggcagcccggcgttcggcatcttcatcgacgacgacgtgtgcatggtcggcaacgagcgcggcctgatcaccacgctcgggcacgacgcgaccgtgctgcagcggttccagcttcccgacggggtgaaatgcatcgtcgccgacgacggctggatctacgcgggctgcgacgacggcaacgtgtacgacctgtccggcaagatccctcggctggcgtaccggatcgcccccgagatcgacatctactggctggacatccacgacggcgtgctcggggtctccgacgccaagggcggcatctcggcgatcgaccacgaggacgagttcctctggcagcggcccggccgcggctcgtcggcctggatggtccgctgcgacgcgacggccgtgcaccacggtcactccggcggtgtgaccagctacgactggcgcaccgggcgggagatgtggcacaccaagaccgggccggtgctgttcggctggcaggagcgggacacgctgtacgccggcaccgccacccgccaggtcgtcgagctcggcaaggacggtgcgcagcggcagatgtatcagtgcgacgcggccgtctactcgtgcgccaccgccgaggacgggcggtacgtgttcgccggcgacagcgcgtcgtccatctactgcttcgacaccaacggcacccggttgtggaagctgtcgaccggctgcggctcggcctattcgatgcagtaccgcgacgagcgcctctacatcgtcaccaccgacggttcgctggcctgcatcgacgccagtgagacggcgatccgggcggcgatcggcggcaccgtcccgcaggccatcgacgtcaaggcgcccccgcagatgccggcggtcgtcccgtccaccacggtcgaggtgatccacgacgcgaccgacggcgtgctggtggagtgcgtcgaggcgggcggccgggtgcgggtgcgggtgctgtcctccggctaccacgccgattggcaggtgcagttcccgaaggggatccgtgagcccggcagccgtttcgtggtcaccggggtgcgtgaggccgcgcggggtggcttctaccgggcgtacggcgatgtgcgccgtctgctctgagccggagtccgtggtggaattcctggcgatcgtgcgggcggcaggattcgaacctgctcagccgaagcacccggtttacagccgggcccgactctccaacgtcggcgcgcccgcgtggcgtgcctgccacgcggtgccctcggcgcgattcgaacgcgcactgccggcgtcctcaacgccgggcctctgccgattgggctacgagggcgggaaagagctggagacgagaaagccgccgtccccgggcgggaacggcggcgcgggagcgcacgagcggctcagccgcgccaccggtcgggggcgagatagaggcgggcatacagcatgatcgtgatctccctgaaagctcggaactgcctccaacctagaagcccgccccgggctcggcaacggcttttaccggcgccggcgtggggcgatgcccgccggagcccagccgaagcccggtgccggaccggatcgacccgcggctgccggggttgcccgggcgcccggagtgcgccggggcggccgtgccgggcggccgaccgtagcggccggtcaggctgcacggatcgcagcgatcgggccgcgtgcacggccggagtcaccgggtgagggtggggcggcgggccgggtcaggaggtggtgggggtgtgcagagcgaaggtgctgtcggcgacgaagtcgtcggattcggagggcttgtcgatgtagagcttggtgccgcggcggtgcaggaagtaatccggatagttcttggagcggacccggaaggagttgcccggctggtcgtcctcggcgcagaaggtggcgtccccgcggaacaggtccgagtcgtctttcggatcgaagcggagacggtagttgtagtgccggaggaagttgccgtcctcgtcgcggaaggtgaagcagctgtcgtcggccaggccttcgacgaccgtgatcgtggcggcgacctcggacatcgcggcgaagtcgccggccacggtgaggtaggtgtcgcggtcgtcggcggcggtgacctgccaggagccggtggtgaggccggacgggtcggtcgggctgggggaggaggccgggctgggggcgatggcggcggctcgggacgggacggcggcgggctgggcggtggggtccgcgggggagcgcatcatgaagtaggcgagcgccgcgacgatgatgatgacggcggtgatgacgagggccagcacgccggggtgcaggcggcggcgtgggtcccggacgtcgacgccgccgggtccgtagatggtcatcgtgtgcttcctcctggtgcgggcgcgaccgacaacgttacgcgctgactggaagaacgacggagaagcaccgtggaccttggtcattcgcgaaccggacaaccgaaccggacaaccgaacacggtaaccggagcggacaactggacgaggcgaccgcaaagctccgcgacgtcgcctgtccaggctggacaagcccgtccgccacgggtgacagcggggcgcatccgtggcccgtccgccccgggttgggtagcgttcggcagatgagcggattcggcgcggcgaatcgggcgctggtggccggctgcctggccctgaccttgaccctggcaccgaccctgaccggctgttccgccgcgtcgaaaccggacccggccggcagcaccccggacgtgggcggggcggaccgcaccccagaggcgggcagggccgagagcaccccggccacgggcaccctggtgaccaccaccgtgaccggcaccgaccaccggatccaggccccgcccggctggtccgtccagctctgggcggagcttcccggcgcccgcctgctggcctggaccccggacggcagattgctcgtctcccgcccgggcgccggcgacgtcgtcgcgctcacccccggcccgcccggcacgaaaccccggcagaccaccctggtcggcggtctcgaccagccacacggcctggccttccagaacaacacgctgtatgtcgccgagagcgatcaggtcgaccggttcacctaccgggccggcgccgtctccggtgaacgggtcgtcatcgccggcctgcccgatgcgaagagtccggagctgggcggtgcctacgcccacgcgctcaagagtgtcgcgatcggccgggacggcacgatcttcgtctcggtcggttcgaccgggaacgtgtcggcgaatgatcgcgaggcgcgcccgcagcgggccaccattctgcaggctccacccggcggcggcaggccgaccgttttcgcccgcggcgtgcggaacggcaccggcttggcgatcgccccggacggctcggtgtggaccgccgtgaacaaccgggacaacatcgccgacccgagtgacggccaggtcaagcagtcctacgtcaacgatcatccgctggaaccgctggcccgtctgacgccgggacgggatctgggatggccgtactgcaatccggatcttgatcgtcggtttgtccgcgactaccagctcaaccgcgacggagcgaagctggactgtgcgaagctggcgccgatcgagcaggggctgggcgcccattccgcgccgctcgggctgagtttcgcgaccctggcggcgccgttcggacagggcgccctggtcggggtgcacggctcgtggaacaggacgccgccacgtgcgccggaggtgtcgttcttcgcctggcgcaacaatgcgctcgggccgcagcagaccctgctcggcggcttccaggatgcgcggggcaaccgctggggccgcccggtgatggcagtgcaaggccccgaccaggcgctctacgtgagcgacgacctggccggggccatctatagggtgcaggcgacggcgacgtcgtaggcgatgcccgggttgtccgccgacttcgggtgcaggcgacggcgacgtcgtagatgatgcccggattgtccgccgacgccaggttcaggagaccgcgacgtcgtcgaagtagacgatgcccgagttgtccgccgacttcaggtgcagctgcaccgcggccgcaccggccggggcgacggtgtcgacgaccagcttggtccaggtggtgttgccgagcggcagccggttcgaggtggtctcggacagccacttgccgttcgcgtcgaaccagctcagcgagatctcggtgatgccggtggcgttgaatccgcgggcgtacgcctcggcgcgccaccggtagttcggctgcactggggtgatcggggaggtgcgcatcgacggcagaccggagctggtgcgggtggtgccggcgaacttcagcgagtacctgccgttgcgcggcatgtcggtgctgaccgtgccgacgccggcgtcgggctggttcgccttccaggtcagctcgttggccggcgcctcgaagcccaggttgaggtagctgttcgggacggtgccggtggtccaggcggtgcgcaccacggtggcggcgagcttggcggtgccgtcggcgcggtacaggccgaaggtgtactgcgcggggatggcggagacctgcgactgggacgggatggcgccggccgcgaagtcgttgagcgtccacggggcgaccgagccgacgccggcctcggtggcggcgcggagcacccgggccaggtatgcggcctgctcgccctcgctcgtggcgccgctgctgaggccggtctcaccgatcacgatcggggccgggctgaccgcggcctgcgccttgcggatctccgcgagggaccgctccgagctgccgtagaagtggaagtcgtagtagtccagcggggtggcggccagcgcggccttgatctgcgccatgccggtggcgccggtgccgccgtcgaccgacagggtcagcggcatggtcggggcggcggcccggacggccgggatgacctgctggacccaggcgatcgcggtcgcgtcgttcggctggaactcgttcttcagctcgacggcgaggacccgcgggtcgtccttgtacgggtcgaggatggcctgcgcccaggcgatgctgcggctcgcgtcgctgtagccctcccaccagtcgaagagggtgagcttgacggtcatgccgtacgagtcggcgatgctgatgaacttgcgcagcttctcggtgtactcgaccttgggggccgggtagccgaacgcgtcggggaagacgatcgcgcggatgttggtggcgccgagctgggccgccttggccatgtccgcgtcgatcgcgaccgggtcgaagttggtccacatggccgaccagccggcgctcgacgggtagtagttgagcgtcttggcgaccttgaccgacgcgagccggccggccagcgtggtggcatcggcggcctgcgccggagtcgcgactcccatcagaccggagcatgccacaagggaggccagaacagcggcacgaagtcggttgcgcatcagggtggcctctcgccaaggttgcatttcggggatgcccgcttcgatcggcgggtttcacccgggttgcagctcttgactgagggcaacaaggttgcaaaacaggagcccgaaaaaaggggcccggaggggcccctttcttgcgctacgcctcttcgggcaggctgtccatgaatgaactgacggagaagaccgccttgcccgcaccggccggcccatagccgggcggactggacaggccatttgcctccatcgttgcccggtacacctccagcaggcggatgtggtactccagcggcgccccgttggggttcgtcctaccgagcggcgtggtcggctcggggcaccaggtggtgaaccgcggggtgattccccgggacatgaagtattgaaggccctcagcggtcgacgcgatcgcctcgtccaccgtggtgaatccgaacggctcggccatctcgactccggccacgaagttcgggatgacgttgcgcgggccgaacacctcggctgattcgaggatccggcggtgccattcctcgcggcccacgtagcgttccttgcccgggcagtacagctcgaacagccgcttgtcccacacctcgtagttcgggtggtagatccggatcccgtagtcgtggaaccgctgcacgtcggcgcggggcagggcctgcgccaccaccttgccgatccagcggccggggaagcgttcctcgatcgcctgcgcgtaccgcccgtagaagtcggcttcggccagcccgtccaccttggaggtgacgctgccgccggtcagcgtgtacgcctgcgacgtcttcagcgtgtcgtgcttgtcgatgatcgccagcgcctcgaggacctcgtcgaccggcttgaccccggtgtagggccgcccggccgccttgtgctgccgccagttgtggttgatgtcgcagtactggcactcctccttggcgccgaaatactgacacacccggaaaaccgtgagatagacgagataaccccactggatggtcggcgcgacctccatcacctgcttgccgttggccagcgcgtgccggtagtagtcgggcatcggcggcagcccgacctcggcgatcgcccgcccgtccaggaacagcatcagccggccgtcggcgtccggcttcacccggtacggcgaggccgggttgatccgcaccgagaccacggtgcggcgcaggtcgtaggggccgccggtgagcacgatctcctccggcggccggcgcagcgccgcctcacccagctcgggcagcgtccggtggtcgaaggagaagatgaagtacgacttcggcttgacgtcgccgccctcgttgtcggtcagcgcggcgtcgtcgaacgccagcccgccacgcagcaggtcctccttgatcaccgcttcccgcgggacgtgcgggaagcggctcatcaagtcctcgatgaggtcggtgcgtgactgcatgactcctcctgctgttcggttcacccccactagctagctagccgttgatcggtccgcgaacgcccctggccgggggtgacgcgcaggacagcccggagcaccggcaagatggttcgggtggacgacgacgacttcatctggtcgcaggcccgccgctggcgcgcccacctcgaccgggtcaacggcaccggcgacaccgagctgacgctgcgcatcctcaagatcaccgaagaggcgggggaggccgcccaggcgtggatcggtgtccaggggcagaacccgcgcaagggcgtcacgcacaccgtcgaccaggtggtcggcgagctcgccgacgtggtcatgaccagcctggtcgcgatcgccagtctcggcgccgacccgcgcgcggcggtcgccgcctgcgccgccaaggccgccggtcatctgccggctgccgatccgccggccacttcctgaccgctgaccgttcagaaaccgattgcggcggtacgatttcagcccgcccgtggccgctcaatgcgatgatggtcgatgtccgtacccggcgggcgtggaccctggcgatactgagcccggatcgccgcccaccgcgaccggcagcggctctgaccggttaggccaggacgagcagcggggtgctgctcggggcgtaggcggtgaagtgccggtcgggggactggcggcgatactcctgcgggctcaggccgcgctcgcgtttgaaggcggcgctcaacgcgaacgcgctgccgtaacccacctcccgcgccaccgcggagatcgtcgcgtcggaggtgcgcagccggtcggcggcgaggctgagccgccagccggtcaggtaggccatcgggggctcgccgaccagatcggtgaagcggcgggcgagcagcgagcgggacaccccggtccgggccgccagcccggcgaccgtccactgctcggccggggtgtcgtgcagcagccgcagggccgggccgacgatcgggtcgtggccggcggggtgccaggcgccggccgccgggccggccagccaggcccgcagcaccgagatgagcagcaggtcgagcagccggtccaggaccaggtcctggcccgggacggtgcggcccatctcggcggtgagcagcccgaccagcgcgcggtcggtggccgcggccggctgcaccagcatcccgggcagcgcggccagcaggcgccggctgacctcaccggccagctggtacgtcccggtgatcagctcggtgccggcctcggtggcgtcgccccaactgcgcaccccgagatggtcgcggggcaatccgtcgaccgtggtgcacacctgacccggatggatgatcgtctgccagggcgtgtccggctcgtcggcgaccgtgtaaggttccgggccgcggatcaccgcgacgtcgccgggatgcagccggaccggctcgtcgcggatcaccacggtcgtcccgcgcagcacggtgaccagggtgagcggcgcctcgtcctggatccgcagcgcgaacggcggctgcaccacggtccgcagcaggaaggcctcccgcgcccgcgccccgtcgagcagcccggtcagagtgtccacgcttctaccctgacatccgcgcggggcgacgggccaggcccagcgccggcgcgaggcatgcgagggccgaggccgtcaggagtgtgcgtacgtcgttgaccggcacccacacgccctcgaagttccgccgcgccgccgccgggtcgctcagtgacgccgccgccaggcggtcgttcagcggcacctcgacagccatcgctagctagctagccggccgggaagcccagcgcgcccacgaacaccaggccgaacaggccgttctcgatcgccgcgttgaggtgccgcatcgcctccacgaacgtgcggtcgtcggcggtgtgcaggccgggcatcaccgaggtggtgaacgcgaagaagatccccgccatcagccccacgcagatcagcgcggcgaccagcacacccgtggtgagacgcggtttcacgcggccgaccagacaccggtggccgctgcggcccgggcgtagtcccggaagtcccggggctcgcggcccagcgcgtgccgcaccccgtacgccaggtaggcgttcctgccgtcggtgaccatctggaagagatcggcgaactcctccgggagaccctcggcgcgcagcgcctcaaggtagtcctcgcgggtcaccggcgtgaagcggatctcgcgaccggtggccgcggtgagctccgcggcgacctcggcgaagctcagcagccgcgggccggtcacctcgtaggtgcgcccgtcgtgtccgccttcggtcagtgccaccgtggccacctcggcgatgtcgtcggcgtccacgaacggctcgggggcgtcgccgaccggcagcacgatctccccggccaccaccgcgggctggaagaacgcctcgctgaagttctgcgcgaagaagctggcccgcaccaccgtccaggccaccccggagtcccggaccacccgctcggccgccgcgcaggccggctcaccgcgcccggaaagcagcacgatccggcgcaccccctgcttgaccgcctgctccacgaatgcgcccaccgtgtcgacggcacccgggaaggccaggtccggctgatagcagaggtacaccgcgccggtcccgtcgagtgcctgcgcccaggtcgccggcaccgcccagtcgaacgccggtgacccggtccgcgaacccacccgcaccggcacgccgcgctcccgcagcagccgcaccacgcgccgcccggtcttgcccgttccgccggtcaccagaactgtcgtcatctccgtcatgcctcgagtccacccgccgcggcgtgcaggagccatggccggcaatcccggaaacataagcgagcgtccacgcccgcgacggatcagttgtcgggaagcacgatcacgtcggccggcggcggcgcctggatctccgggaacgtggcgccgaactcgctgaacgacagggcctggaacttccaggagagcttgagcgggtacgccgcgccggtcgtggcgacgtagagggtggtgccaccggactgcacggcgatcgcggggacaccgttgagcacctgcgtggtgcccttggtcagggtggtgccaccggtcagcagaccgtcgaggaacgtcctggtgacgaaatcgccgtagacatcctcgtcgggacggagcgtgacccagtggccgccgagccccgccagcagcttctccgcatcggcgcggcgcatctgctgcgccaggatctccaggctggaccgcaggtaccgtttgccgccgacgacgagctcgtcctgtcgggactgaccctgcgcggtccagccggcccggtcggtgccggacagccgcatgtcgagctgccagagccgccctttcccggcgtcgcggccgaagcggctgccgtccgggtacagcgagccccggacccggaacgagggggcggccttcagcgcggcctgcgcccgctggacgatctgctcggccggcagggcggcgacgccgttgtcggccggtgccgaggacaccaccggagcgggtttcacggcgtgggcgcaaccgccgagcagcacggcgccgacggccagcacggcaaagatcttcacgattgtccatcccccgtagagctctgcggggatggtacggcatcgatcgttgcgtcgggtctcgggattcgcggccgacttctcggcgccgtccgacgcggtggcggcgaccgcccgggccgacggcctcaccccgttcccgcggcgctgaccgatccggcccggtaggcggtcgagggcggcgagcacctctaccgcagcgtcatcgtgtgctcccggcggcggccggccagcacgtcggcgccggcggcgagcagggcggccaggatgaaggcgatcgttacggtcagggaggtgcggaaggccagcccccagtcgccgttgtggccggccagacggttgaagaagaccgagccgacgccggcgatgccgatcgcggcgccgatccgctgaccggtctgcagcacggcggcggcgctgccggcccggcggaccggtacctcgctgagcgtcagcgtctggttggggctgatcaccaggccgctgcccaggccggcgaccagcagcggcacgacgctggcccagccggccgcggtgccgtcgacgacgtgcagcaccagaaccgtgccggccaggccggcagcgacgacggccaggccggcgaccaccagggtgcgcccggtgcggtcgacggcgcggccgccgagtgccgcggtggccgccgagccgagcgcgaacggggtgatcgccaggccggcctgcagcgccgagtagtgcaggccgttctgcaggaacagcgtgtaggtgaagaagatcgaggtgaacccgccgaagtagaggatgccgaccagggcgcccagcgcgtacgaccgggtccggaacagcccgaggtcgaccaccggggtggaccgccgggcgaagcggcgttcccagacccagaagccggccagtaccgcggtcgcggcgacgaccagcagccacttcgcgttcccggtccactcgcgttcctggaccagtggcagcaacagcaggaacacgccggcgccgagcaggagcacgccgaccgggtcgaggctctcgtgctcgcgctgctcgggcgggcgggccgggatccagcgggcgcccagcacgatcgccagcaggccgatcggcacgttgatgtagaagatccagcgccagccctgctcggcaccgaacaactggatcagcagcccgccgagcagcggcccgaccgcggtcgagatcccgatcgtggcgccgagcaacccgaacggcttaccccgctcgtgtggctcgaacaactgctggatcagaccggacacctgcgggttgaccacgcccgccgcggcgccctggaccagccgcgcgacgatcagccacagcgcgccggtggccagcccggcggccgcgctggccagggtgaacacggccagtccggcgatgaaggcggtgcggcggccgcgggcgtcgccgtaccggccggccggcaccagcagcaggccgaaggtcagggcgtagccggacagcacccactgcagctcgccggagccgaggtgttcctcggcgcggatcgagggcagggccacgttcacgatgctgacgtcgagcagggtcatgaagccggcgaccagggcgacgctcatcgcccgccagcggttctcagatgtcactgtcgggcagtttcccccggtgggcgggggcaaacccgtcggatgtacccccgctaccgtcttttattctgccagatttttcgctgaaaaggacaggaatgaattccggggcggtgggcattcggggtggcgaataaccgctcaagggaggccaagtgagtgagctgccgaccggcgcatacgcgtcgggtcaacattctgatcagaattcctcgaaagccgcgcaggtggccgccgaaggcaagcaggccgccggccaggccgtctccgaggtcaaggacaccgcggcagagcaggtgcggcgcgtcggccaggaggcgggcgcccaggcccgcaacgtggccggcgaggtgcgcgacaagctgggcgagcacgcccgggcccagaacgacaagctggtcagcggcatccgcgagaccgccgatcacctcgacgagatgcgcggcgaccggtccggcacccccgccgcggccgtcgtgtcccgggtcgccgagggcggccggcagctggccgactacctcgaccgcaacggccccgaaggggtgctcgccgaggtgcaggacttcgcccggcggcggcccggcgcgttcctggcgaccgctctggcggccgggttcgtggtcggccggctcggtaagagcgtggccaaggccgacgaggccaccggcggcaagccggccggtgacgcctactcgtcggtgacgccgtcgaccgcgcccaccagcagcttcgcgaccaccaccagcaccgactacgccagcgcgaccggcgccggcgcggactacgtgggcaccggcaacgagtacgcctccacgaccggcgcgggcgcggactacgtgggcaccggcaccgggtacgccgccacgaccggcgcgggcgccgactacctgagcaccgggaccggtacccccatcccggtgcaggaggaatacccgatcggcacccgggagccgcggccgtgaccgcccccgagaagtccgaccaggtcgcgcagacctcgatcggtgagctgatcggcaacatcagcgacgacctgtcccagctgttccgccaggaggtcgagctggccaaggcggagatcaagcaggaggcgaccaaggccggcaaggcggccgggatgctcggcggcgccgggttcgccggctacctggccgtgctgatgctcagcctggccgcggtgttcggcctggacgccgtgatgccggccggctgggccgcgctcatcgtggccgccgtctggggcatcgtcgccgcggtgctgtacgtgaccggtaagaaccggctgaagaccgtggacccgatgccgcggcggaccgtcgagacgatcaaggaggacgcgcaatggctgaagaacccgaccggctgaggcaggacatcgagcggacccgcgcgtcgctgacccgcgacgtcgacctgctcgccgagaagacgagcccgagcaaggtcgccaagcggcggtggagtgcagtgaaggagaaggtcatgggcagcgccgactacacgcggcaggcggtgggcgagtccacgtcgacggtgcaggacaaggcctcgcacctggccgacgtggcgggggagaaggcgtcgcatctgaccgacgtggccggcgagaaggcgtcgcacctcggcgacgtcgccggcgaacaggcgcaccgggcggccgacgcggtccgtgcggcgccgcaggcggtggcccggcagaccgccggcagcccgctcgcggccggggtgatcgccttcgggctcggcctgctggccggcggcctgatcccggtcaccgaggtggagaagcgggccgggcgccagctcaaggagaacagcggcgacctgaccgaccgggtcaaggacatggcgagcgaggtcaaggacgagctgaccggcaccgtccagcaggccgcccaggaggtcaagggcactgctcaggaggccgtgcagaccaccaaggagcaggcgcaggactccgcgcaccgggcgaccgagcagacccggcacgccgtctcctgaggtcacggcgccgcccgcccagcggtgtgcgggcggcgccgatgtgccgtcccccggaggtttccgtgggccgtcgacacgacgacgccgtcgggcccgggggagggcctggacagtcctgcggaattgcgcggcaggggattgttcgcggccctgcggcgtaccgtcagcaattctctgaagacaatctcggtgactgggccgcggcgctcacctattgcggcgtgctctcgatctttccccggtctgctggtcattgtttcgctgctcggaatgctgagccacaacagtcggaagtggtgcaggacgccgcgcaccagccggccccgtgctcacccaggtcaaggaccccggaacggcgggtttcgcggcggtggccggggtgctggtcgccttctggtccgcctccgggtatgtcgcggcgttcatgcgcgcgtccaactccgtgcacgacgtgccggagggccgcccgatctgccgtcaccacccgaagcatcgtgaagtggccggtgctgctggtgccggtcagcctgatgttcgcgctgcggtacgaccgcacgctcaaaaagcatgattgatgacggaccggttgccggcttgttagcccccgcgaagacttccggtccggcggttaaaagctgggtgaagtatccgacagtaccgtttggaggccttaccgtcgggtacccgccggcccccggcacgcgcgcgccgtgcggggagcgcaaggaggcgccacgatgaaccacgacgatctgctcatccggatccagcggagcgggcggctgcacggccggaacgagagccgccggatcgccgtgaccgtactgggtgtgctgagcgaggtgctgccggccgcggcgtaccgccgcctgaccgcgaccctgccggaggagctgcggcagcggctgcccccggctgagccgggccggatcgtcgagatcgtcgactgccgccggttcctggcccgggtggccgcgcggctctacgccgatggcggcgacgcggccttcctgacccgggtggtgctggccgagctcaacgacggcgcccgcggggtgtcaccggccgagctggcgcatctggtgccgatggatctgcgggccctgttccggtcccggccgctgctgccgtggaccggtgccgccatcgagccggacgtcgcctaccaacgggttctctgaccggcacgccggtgccggcacccgatcgggtgccggcaccggcgtctgctacttgggccaggtcggtggcttcgggttggggttcgggccgccgccgcctccgcccgagacgcaggtggacacccagatggtgacctccgtcgaagcctgcaccttcctgccggcctgcggcgactgcttcacgacgtcgccgggcgagaggcagtcgttggtgtacttgcggacggcgttgaggtacgagctgtcgatccaaaggtaggcggtgtactcgtccagcccgagcagcgccggcacgtgggtgaccgcgggcagccaggtgaacgactgggtgctggtctgaccgagagcgtcggtcaccgtgtagacgaccgtcgtggccggaccgttggccaccccggagagcacgccggtggaggtcgcggtgatcccgctcggcaatccggtcaccgaccacgtgtacggagcctggccacccaccgctttgaggttcgtcgtcgtcggtatgttgggaagcgtctcctggtcctgggtctcgagcgcctccaccggcatcgggtccggcgtatgcggggagtaataggtctttccgcccgcctggatgtcgcagaacccgtcggcgttgacgtcgcccagggtgatctcggtcagccgcagccacgactggttcacgaagacccagcggtcggcggcgctcgactggtaccaccatccgataccgctggccagcagcgggtccagcttcccgtcgccgtcgaagtcgcagtacttgcggtcgccgacgaggggcgagctgaacacgttgccgcccttgttgttgagcccggtctcgttctgcttcagcgtgtcatcggcgctctcggcgaacacgttgttccagacgtcgaaggtgatcgagggcgtgccgcgcaggtagacggcgggggcgccggtcgtggtgacggtgttgtagcgcaggtcgacgtaggcgcccgccggtccgcagttgtagacgctcccgtcctgcccgcatccggtgccgtgcatgtcgatcggccagccgtgcttgccgttcgtggcggcgtagcccgggcgttcgaagaggttgcggtaggccagatagccggttccagggtgcccgtcggccgcgatggagtggcggttgaggtcgaacgcgttccgctcgatcagggcgtaggcgctctcgtagagcacgatgccgtagccggcgccgtggccgtcgtcgccggccgggtgctgattgtcgtggatggaattgtcgtggatccacaccgtgtcggcgttgtccaggttgatccgctggtcgtggtcgtagacggccacgccaaagccccgccagcgggcgaactcgctgtggtcgatctcgatgtgctggctggagaagatcgagatcgcggtggcgtcgggggtgtcggccgacgccatcgggtccgcgggttccaggccgtcgaaccggacgccgctgatccggacgttgtccgacggcgctccgtagacaccgatccacagcagtgagtccggataggtggtggtgaacacccgcgggccccgggggttgaccgaccggtcgccgagcaccttgacgccgggggcgacctgcacgtggtcgagtccgctgaggtcgagcacgacgtcgccggggatctggatcgtcgccccgggcgtccggatcgcccggaggaactcgcgtcgctcggcgaggtcgttgctgctgatggtcaccgcggtaccggccggcaggggttcggcggggtacgggacgacggtcgggaagaccgacgccagcgtcttggtggagctggtacctatcgacagttccagcgtccacgccttgtgttcggtgggtgtgacggtcatcgagccggtggcggacaggaccgggccgatctggcgccggttgccctcgaacaggcggatctgcggggtgccgccgtcgcagaccttggtggcggccaggttggtggtccagctgagcttggtggattcgccccactggaccgtggagtcgaaggccagcgagccggtggcggcggccagacaggccgcggggtcgaggatgtcggcgacggccgggccggcgacggccaggccgccggccgtcatggccagggtcagggcggcggccgcccagggtctgtggtgaatgcgtgccatggcgctgaccgtaggatcggcccgggtccggccggagcggtaatggatactcatctcttcgtcggcactacctacgcggcgtcggaaggccgacttcgccgcggccccggcgtgggtagagtcgcccgccggaggtcccggatgtacacctggaacgatgacggccgatggcccctcgtcgggcgcgaggacgaactgcacgccttcgccggcctgctgagcggcgcacggcggcagggcttcgtgatcagcggcccgatgggcgtcggcaagtcacggctggcggtcgagtgcctgacccgggccggcgcggccgggttccgcacggcccgggtcaactgctccgaggccgccggcaccgtgccgctcggcgccgtcgtgcacctgctgccgcccgacctggacctggccgacccggtcgcggcgttccgccgggcggccgaggtgttcgccgtcgggcgcgacgagccgggatggctcctgctcatcgacgatctgcacctgctggaccgggcctcggcggtgctgctgcggcagctggtcgacgccgggtcgatccggttcgtcgcgaccgtccgggccggtgccccgcagaccgccgcggccgacgcgctgtgccgtacggatgcggtgctgcgggtggatctcgggccgctgcgccgggacgacgtggccgacctgctgcggcgggtgctgggcggcccggtggcccagcagaccgtccgcgagttcggcacggcctccgcggggaacgccctctacctgcacgagctggtggtcgacgcgctgcgccgcgcggccttccggtgggacgggctggtctgggaggccgatgcgccggccggcaccacccggctgcgggaaatggtccggccgctgctggctgcggcgggccgggacctgatcgagctggtcgcgctctgcgaaccggtaccgctggccgaggccgagcgggtcgcgacgccgggcgaactggccgggatggaggccgccgggctgctgcgtgccgaccgggacggcccgcacaccacagtgagcttcgcgcatccgatgtacggcgaggtggcccgggccgacgtgccgctgctgcgccgccggacggtgctgctggagcaggcggagcgggtcgaggggtacgggctgcggaccgtcagcttccggctcgcggccaccggcaccgccgatccggagctgctccgccgggccgcgacggtggcgcggcacgcgcacgactacccgcacaccatcacgctgctgcgtgccatcccgcagggcgtgcgcacggtggccgacgtgctgctgctcgccgacgccctgctgcacctgggccgcggcgcgacggccgagcgggagctggcggccgcggccgggcatcacgctctcgccgaatccgaccgggtccagctgaccatcgcccgcacccgcaacctgtactggcaggacacctcgccggcccgcgctctggcgatcaaccgccgggcccgggcggccgtgaagagcgccactctgcatcacgtcctcgacctgaacgagggctgcctccggttcgtccagggggagatgaccgaagccgtgcgcctactggatcgtctggaacccgaggtcgacgatgccgccgacgtgaccgtctggttcctggccgcgggcctgaagccggacgcgctcgccgccgccggccggaccgccgaggcgatcgagtgggcccggcgggcctaccgggccaaccggcgccatgccgtccgtggcctgctgccgcacgccgcgtcgcacctgacctcgctcggtgccgcccaggccgaggccggtgacctggcggtcgcccgcgagacgctgaccgctgccttcgccgaactgctcgacgccggtgccgcccgtccccaggtgtgggccgcgatgaatctgggccggaccgagctgatcgcgggccggctcaccgcggcccggcactggtacagcgaggctgcgacgctcacccgcgctctcgggtaccggcgcgcgcacgccatcgccacggccggtctggccgccgccgccgcccagcagggcgagccgcggccggacgggatgccggcggacggcacggtcgacaccgatcacgaggtcggccgggcgtggacgctggccgcggccggccacctcaccgaggcccgcgagctgctcggcggcgcggtgggggtggctcgcgcgggtggccgggtcaccgaggagctgtacctgctcaccgagatctcccggctgggcggggcgaagcctgtcgcgcaccgggtggccgagctggcccgggagtgcgacggccggctggccgcggcccgggccgcgttcgtcgccgcgctggccggggacgactagctagctagcgcggcgcgcggccgcggccgctacgctcgcggtccggcccgacggcgccgcgacgccgctgctcgcggtccgtgagccggtggtcccgctgaccggccgggagcgggaggtggccctgcgggccgccgcgggagcctccagccgtgacatcgcgcgcagcctcacgctctcggtgcggaccgtcgacaatcatctcaaccgggcgtacgccaagctcggcgtgaccggccggcgcgacctgcccggggcgctcgccggctagtcagacgtcggcgacccggccgaacaccgagcggtggaagaccagcggcgacagcgggtcaccctggtcggccgggtggtcgacggcgtgcagacggagcaggacgatggtgtggtcgccggcctccacctcgcggtagacggtggtgtcgaaacgggcgagcccgtcgtcgatggtcaccgagccctcgtcgctgaccgacaccgggatgccgtcgaagcggtgctcgaccgccccggccagctgccggcagatcgccccgtggtgggcggccagcacggtcaccccgaggtggtcggcgcggcgcaggtcgggccaggtcttcgaggtgttggcgatggagaaggagaccagcggcgggtccaggctgaccgaggtgaacgagctggcggcgagcccgaccaggcgcccgtcgacggcggcggcgacggccaccaccccgctcgggaacacgccgaacgccctgcgcagccggatcggatcgaggtcctggttggtggtgaaggtcgcgggggtctgcgaaatggtcatggtctgttcctcaccgtgggacgtgcgcctgacctgaatctatatcgatcctataggttttcggaagtattggtgacgtcacaatgagcgccggaccctatgtagcgaaatgtgctcacgctatgtagcgtgtgcgggatggcgtcacccctacgcatcaccgccgccgtcgccggcgtcctggaggcgtttctcgccgcgccgggcaccgagcggtacggactcgacatcatgcaggccaccgggtatcccagcggcaccgtgtacccgatcctgatgcgcctgcagaaggccggctggctcgccgcgcactgggaggagatcgacccggtcgccgccggccgcccggcccgccgctggtatcgactcaccccggacggactgaccacggcccgcaccgaactcgccgcccaccgccagcgcaacgcgatcggcccggccgtgcggacgaggccgacatgggcctcctgaacaccctgatcgccgccttcctgcgctccgccgcccgccgctggccggccgacatccgcgacgagatggcccgggactggatcgccgaactcggcgccctgcagcagcggccgggcaccgcctggcgccggctgaccttcgcgatcagcctcgccgccaccccgctggccatcgacgagagcggcgccccgcgcggccgctgggagtggatgcgcgccggggtcaccctgcgtaccgtcgtgcgcctgatgctggtcgccgggttcggcctgggcggtgcgtccgcggtccgcctgttcgccggcgacctgttcctcgacgacctcgccgacgacgccgactggctggtcttccagctcaccgtcggcctggtgaccacgctgctgatcaccgggtacgcggtgaccgccgcccggtgggccggctcgcggggtgctcccgagcccggccccagcggcagcctcggcgtcgccgccaccgccgtcctgccgatcgcctggatggtgccgttcttcctggccgtgcacgcggacacggtgttcaccatctgcctggggatcaccgccacctgggcggcgctcaccatcggcctggtggtggccaccgtccgcgcgctcagcgccggccgccgcggccgcgcctggctggtcgccggcctcggcgtcccgctcaccccgatgctgtcggccgcccccctgctgctcgccgacatcgccggctacaacatctacctcatccaggcgctcctggacgtggccctgttcctgctgccgtggaccatctgtgcggtgaccttcggccgggcggcggtgcgccgctggtccaccaccgggcccgcgaccgacgccgtcccggccccggagcaggccgccgtgcagctcggctggtggcagccgaccgccgaacgcctcctgctgctggccctcaccgtcaccgcggcgaccggctgggcgctcgggatgaccgtgctccagccgatgagcgagcccaccggccccgacgcctacggcgagaacaacacctactgggcgcgggaactccgctggggcgccctcatcgcgctggttgtgatcattctggtgtacgtgcggggcgaccgccgggccacccggagcgtcctgctggggggcgtcgcctggctggccgccgacatcgcgctcgaccggatcaacccgaccaccgtgctgctgccggtcgccgccgcgctcaccgccctgctctgctgcgccgccgccggtggcctgcccctcgtgccgcaaccccgcaccctgttcggtgccgccctggtcgccgcgatcgccgccggcctggccaccgacaccgaatcacccaccgacgtcgaacgcggcctcaacctgggcagcgccgcggccggctcgctgctggcggtcgtcgcgatcgtcgcggcggcccgggtcgccgccacggtcagccgccgccggatcgccgccgcgatcccggccggcctggtcgccgccgccaccccgtgggtgctgcgcctgatctacccgcaccccaccgacgcccgcaactacggcacgctggccttcaccgtgctgctcggctccgccgtggtcgccctggccgccccccggccgcggacccaccgcgactggctgcgctacccggccaccgtgctgatcaccacggtgtccgtcccgctgatgttgttcccgctggtcatcgcgtccatcgcactgccgtacggcgcgctgttcaccgccctggccggcaacccggaaatcaacagcgcggacaccgacaacgtcgcggtgatcctggccgtcccgatcggcatcgtgctgggccgcatgctgcgcggcttcgccttcggccgcccccgggccaccgtccggcgcaccaccgagccgccaccgaaagcccaccccagccccgcctgacctcgggactgccgggccggcccgccgcggccggcccgggcccgcctgacccgggggtcccggtcggcccgccgacgccgaccggcttcaccgtaacgggtggtccgctcgtgcgggcggctgtcacagtggcaccggtgaggcggcattcggctaccggcgcgcccgcgacggcggcctcgacggataccggctggtcatccgagggtcggcggcgttccagcggctgcactgggagactctgcgcgacccggacaccggggtctgtctggccctgcgcatgccgctcgtacgccaggacgcccgggtgccgctgcagcaccgactgccggccgcggcgccgaccttgaacatcctggtggtcacggcccggccgttcgggtcccgggatgtcggctaccggtgccgtcggcgcaggtggcgcagctgctggccgagcaccgggtggcggtcgcggtgctcaacgcctgccagtccgccatgcagaccggcagcgaggcgagtctcgcgcaggacctcgtggcagccggagcgccggtcgcgatggggatggcatattcggtcacggtttccgcggcacgacaggcaatgccgattttgtacggtcgtctcgcggccggcgacgacccggtgctggcggcgtggcaggcgcgccgatgcctgcacgacgacaagtcccggcgcggctacttcgagcagcacctggacctggaggactgggtgctgccggtggtgttcgcccagcgcgactcgtcgctgagccggcgtccgatgaccgccgcggagcaggagtcgttctaccgccgccgcgagcaggtgggacgccgcccgggccttcctccagggactggtggagtggcgcgagtcccggggtagctggccgagcgacgtcgacgagatccggagcaggatcgcgaaggtgcccgtggggacgctcggtcacctggtcgcggagatcgttcccgccgggctgggggacgaatgggagcggatgttcggtgcgggcgcagcagtggtggaccccggcacggattgacggggccgatggtgggtatgcggatgctcgttccgatgaccgcgacccatggaggaagccgtgaccgacacgtctcagcgcgacgtgatcgacatcctgaccgccgaccaccgtgacgtgaccgcgttgatcggggagatcaagcaggtcgccgatccgatgatccggcgggatctgatcgacaccgcgatcagtgagctggtgcggcacgccgtcgccgaggagatgtacgtctatccggcgatgaagaagcacctgccggacggtgagaagtccgtggagcatgacgtcgaggagcacaaggagctggagcagacgatgaagcggctggaggacgtcgacgtctccagcgccgagttcgacgccgtgctgctcgaactggagaccatcctggccgatcacgtgcaggatgaggagaccgaccagttcccgctgctgcgcctgcacatcccgcgcgaggagctgattgagctgggcaccaaggtggagacggcgaagaaggtggcgccgacccggccgcacccgggggcgccgaacaacgagctgttccacaagctggtcgggccgggtgtcggactggtcgaccggctgcgggacaagctgaccggccgcgccaccaagtaggcccgtgcgccggctgctgttccttctcgcctcggcgacgctgggtgcgggactcctgatcctgttgagtgcgggtaccggcgccggccggccgttcggcatcgcgttctgcgcgctgctgacggtcggcggcgcggtgggtgcccgccggggtcgcgggccggtggcccgcggggtgcgcagccctcagctggcggcgaacttcggctgcgccctcgggctgtgcgtactcgccacactgctgtggtggtggcggccgtcggtcgggaccggaatgccgatcggcgccttcctgggttgctccgcggtctccgcggtgctgatgatcgtggtcgggctgaccgggcgtcgagcagaaacgggcgaatgaccggggcaccgggcgggtatggaacaggtcatgattttcaacctgatccgccgcttcgtcatcacgttgatcgcagtgccgctcgccgcggcgggcgcgcgcaagctcggcaacaccctggaggcgcggcgcggcccgaacaagaccagccgcctgctccggcagggcgccgacaccctgcagggcttcggccggcagaagaagcgcagccgcttctcgttcagccgctgacctgaccgccggcaaggcgcgaaagcgcccggcggcgagggtgcccgccgcgtcagccgaggaggcggtcgagggtttcgcgagcggcggccgatccggcggccagcttcgacagcaccccggcgagggcgaccagccagtcgtcgacatcgaccgtgctgcgcttgatggtcaccccgcgcacgatccggcacacctcggcgtgcaccccgtgcgccgcctgccggagcaccagttgctcgtcgggtgtggtcacggtcagcgacacgggggtcccgggccggccgcccatccggtcggccagggaccgcttgcgctccacctcgaccatgccggccgggagcgcgtcgccgaggacggcggtcaacacccgggtgtacgactccacgtccgcccggtcggcccgcagcgccgccgcgatcaggtgcaggtcgcccatcgggccgagtccgtcggtcatcggtcggtcagcgggagcacgagctgcggcttggcgatcacgtgatcggcgcgcagcggccggaccgccgtgccgatcgcgaagaattcggtggtgtgcccgccccagcggtgcgagttggacagcatctgcaccccgacgatcccttccgcgcccagttgttccgcttcggcctgcatccggctcatcgccagctcccgagcgtcgtacaacgcctcggtgtattgcggaatctccacattctgcccgatgttgccgaccgcctgccagaaccgctggtgcgcgatgtggtagacgcaggtgcccatggtcatgcccagcggggcgtacccggcctggatcagcgtccagaaatcctggccggacaggtcgctggtgaacggctggtcgtgccggttgcgccagccgccgccgctgtccgggggcgcatccgccttcaccgcggtgccgatcgcgatgaactcggcgagctcggagccgaactccttgaactcgatgtcgaggcgcaccccgacgatcccgtcggcgccgagcgcgtccgcttccgcctccatccgggtcatcgccagctcccgggcgtgatacatcgcctgggacagctggtcgagctcccggttctggctccagcggccgaactggatgccgacgtggtagatgctcgatcccagaaccagcccgagcggccggaagccggcctcgcggaccagcaggaactcgttgacgctcaggtcggaggtgaacaggctggtcggctgcccgggccgcatctgcgccaggcggcgcatcgcatcatcggggacgccgggggtcggcacggtcatcgagggctccgcaacggcaggatggtcagactgttcggggtgctgagctgtccggttctgaactgggcgatcgcgttgccggtgacgatgcactcggcggcgtgatcggtgtggttgtcggcgacctcgatcgcccacatccgggacgacagcccggacatcagtgccgcgtcggcgccggtggcggcgacccgccgggcgaactcgtcacgcgcgaccgcccgcacgtggctgatcagctcggtgtacccggccacctcgacattgccggcgaaaaacgacaacgacgatgtcgtccgccagtcgtcgtgccggatcgcgacggacaggccgtagacgatcccggccggcacccatccggcgccgagcagcttcgccacgtcctgggcggccaggtcggtggtgaacggcacgccggcgcgctggcgaccgcgggcgcggaccgccgtaccgagggccatgaattcccgtttctgatcgtccatccgggtctcggtgagccggacgccgacgacgccgtcggcgccgagcgccgcggcctcctgccgcatccggtcgagtgcggtgtcgcgcccgtgccggatggcccgcgtgtacggcgcgaagccggcgccgctgggccgcccggccgcgggccccgggtcgccgagcagcccggcgatcagccccgggttgacgccgggacgccagccgcagccaccccatccggtccacccgatctgcatcacggtggtgccgagcacctcgcccacggtgtcgaagccggccacctccaggccggccacgccgtccgcggacagcagcgaggtccgcaccccgccgttggcggcccgggcgatccgcgcgcgagccaccgggggcagcccccgcccgtcccacccgtcgacgctcaccccccagtcatactccgttccccggtttccggcagtcccggggcggttcacccgcccgtgggaaactccgccctgggcgggtcgcgaggtgcgacgatgcgcatcgggatcgataagctcggcgcatgctcaccaccgtcgactatctggccgccgacagcgtcgacgaggtgctcgccgcgttggcggacggccggacgtcggtgctggccggcgggcagagtctggtcccgctcgtgacccgcccgggcgcgccgcgctcccgcctggtggacatcaaccgggtggcggggctcgacacgctgaccgaggtggacggcttcctgcatgtcggggcgctggtccggcaccgagcgttcgagtccgacgcggtcggcggagcgctcggccagttgctgcgggtggtggtgcgccacatcgggcacccaccgatccgggcccggggcacgatgctgggcagcctcgcgtacgcgcatccggccgccgaatggccggcggtggcggtgaccgtcggcgcgcggctggtgctggacggaccggccggccgccgcacggtgccggccggcgacttcttcaccgggccgttccagaccatccgccggcccgaggagatgctgatcgaggcggagctgccggtgctgccgggcgggaccggcatcggctacgcggaggatcggcgcagcaccacgttcccgcacgcggccgtgctcgcggcgatcacggtgaccgcgggcgcgatcagctcggcggcgatctgtctggtgaactcgggaccctgtccggtgcgcgcgacggcggccgcgacagccctgctcggcagcacgttctcggacgccgccatcgccgccgcggcgcgcaccgccgcgcaggacgacacccgcctgctcgccggcgacgcccggcgtccgggacggcggcaagccttcgaggtgctgacccgccgggccctccggcaggcccggcagggagccggccggtgcgggtgaggctgaccgtggacggcgtgcctcacgacctcgacgtcgagccccgccgcactctcgccggcgtgctcgggatgcccgtctgcccggacggcgcctgcggcgactgtgacctcgcggtggacggagtggagatccgctcctgtctgatgctcgccgtgcaggccggtggcgcccgggtcgtcacggacgtcggtcgtcgccgggctccgggtccccggcgtacggcttgatccgggcggtccagggcagtgtcctggtcggccggcagatcaggcggtgtctcggtgccgcgcccggtcacctacgccacccagggcacctggggcgacgggtagaagttgaggcccgcggcccgccagcgcggggcctgcgcggccagccgcagccggaacacgtcccagtcgtgggtcgcggccggcgaccagcccaactcggcgatggccggcaaccgcgggaacgccatgtactccaggtcgttcgacgtgcgcagggtctccgtccacagcggggcctccacaccgcggaccgcggccgccggcacgccggtgaggtaggcgccggggtcccagccgtaggcgtcgcggacctcgatgagcccggcccagtcctgtcccagcggtgtctgcggggtgtacttcatgtccaggtaagccaggttcgccggcgacagcacgatcccggttccggcgttcgcggcggcggcgacggcggggttgtcgggcgtggtgtcccagtactgcgcgaccgtcgacggccgcgggccggccgccacgatctggtgccaggccgacgccgccttgccgtgccgggcgacgatggcctgggcgcggcgcatgaacgtcgcgtagtcggccgccggggtggagtctgcctcgtcgccgccgatgtgcaggtagcgccccggcgtgatggcggccaactcgccgatgacgtcgtcgaggaagcggtaggtgatctccttgccgacgcacagcgagctgaagccgacgtcggtcccggtgtacagcggcggcgccaccccgtcgcagttgagctcggcataggacgcgagggcagcgttgacgtgcccgggcatgtcgatctcgggcacgacggtgatgaagcgccgctgggcgtaggcgacgatctcccggtactgcgcctgcgtgtaatagccgcccgggtcgccgtcgacggcggtgctgccgccgtaggtggccagccgcggccagctcctgatctcgatccgccacccctggtcgtcggtgaggtggaagtggaaggtgttcaccttgtacgcggccagctggtcgaggtaccgctcgacctgctcgacggtgaagaagtgccgcgccacgtcgagcatcgccccgcgctggccgaaccgcggccggtcggcgacccgcccggcgggcacggacagcggaccgcgggtgggcagcagctggcgcagtgtctgcaccccgttgaacaggccgtgcgcgtccggggcggcgatacgcacgccgcgccgatcgacgccgagccggtacgactccggggccccgccgccgcccaccgtgagcacgatcgcgccggcccggaccgagcgtacgaccggcagcccgaggagctcgcccaagtagtcggcgaccccggccgcgcccggtccggcggcggtgatcgtggtgtgtcggtctatacggaaggcgccgcgcccggcctgtgcggagaccggcgcgggaacgatggtcgcgtaggcgttaccgggggtcggcgggcttgccgcggcgggcggcgccacccctgccaccgatgaagccacggctagcagcatcgacaccagcgtccgacgcaccatcgcgcgccccctcaactgttaaccattctgcctaattgatgggaagctatcacatcctcggccgatccgtggccggccagtgaggtggggccgtggcggtcgaggcgcggtccggtgccgccggaagggtcggatctcgaaccgaccctggcgggaggctgcgaacacgaacaccgatgttcccgcgcgcgctccttcagtccgggctcgctgatgagaacggtagaagccggggcgatcgtcccgcctcggtcgagctgacgcagtcacagcagacttgcgcaacgctggtcactactccggtgggacgggcgttcagtggctggggcggcgtccgccccggccggcaaggaggagaccggcgaccacaaggacaatatggccagccagttgagccctgaagccgccgggtagccaaccgagcaggccggcgttgtcgtggtccacgagttggcggactgcgccttgagctccgtagaccagcagaatcatgccgatgaccagcgtcgtggtcctcatgacagagctcgaagacgcgacgatccgccgcgtcgcggcggaggcgggagtgcccgcccggcagttgcagtactacttcggcacccgcgacgacctgctactcggcgccctcgagctactcaaccgcgacggccgaagcgtcacctacccgggcgccggacgacgctgggtcacagccgtcggctcggcggcggggccctacgaacgcgctcaactgccgatgagcggacatctagctagctagttatagccttggcttcccggctccacattcccgggctctggcaggctctaatcgcgggcagccagattggtttgcggaactagttagcgacggcgagtgagcgtcactgaaaaagaggttcagtcgcgacgaactctacggtggaccgggcctgcttatagggagacggtgggccttggcattaagagcgccgcggcggttaactatctcctacttttaccagggcagcgatttctgctgccagtttcgcccgagcagtcgtcgatgacaagcttttccttaactccttcaaaagggcacggaggcgctccttctcagggtcgcctagataggggactaaagctcttgcgacgagcaacgctcggtactgttcatcgcgtgatcgcgcctcgagcgccactgtacagacggaatcaaggtaactcgcatcgggatgtatctccatgatcgtcaatgcggcgatgcgctcgccgctgcttccgctcgacaaagcttctattaccgccaccgggtcgtacctgcccagcttcacgacggagcgtgcttcgtctgccaacctgtcgaactccgcggttctcggaggtccggctggcatcaatcttcgcgctctgtcatacgctgcgcttataggagatagtccgcgcagtacgtcgcgcgcctgttcccgcgcgccttcggcgccgagaggatcacctgccctttccatctcgtcagccatatggttcagcaccgcggccgcggccgctcgccggtcggcccgcaccattgccgttcccagtaccagccgcgtgtagagccaacctgtaaccagaccgaatacggcggagaacgtgaccagccctcctgcgaacgccttaccggccactccgccgccaaacgagggcgccagcgcaccgaacagatcaacagcggacttcccgatcgagtgaaactgcgttaagccgacgccgaccaagattttagtgagccagtcactaatttgttccaagttggtgttggcggcaacaccgaaagagtccgcacgacgctcggcgttctccgtggtcagctgtcttggaacaccgaatacgaaccctattaggccgccactcagcatcgcggccaacgaaacgacgatgcctacggcgaatatggcggtgccggcggcttgttgcgaggagaagacaacgagcgcggcgaccgcagccaagattccgatgccaatccagccgagcacggcacgccagacgttagcattgccttcacgcggttctgaacggttcaccaccacagcaggatccccaagtcgtcgtcgggacagcatctctacgtcaatgtatgcggcaggggacttctacgcccgtatttcgtagtgcaacttccggcgagttgcatcgacctcggagcgagacgtcgtatagtctgcggcgtttaccaactttcgtcgaaagcagtcgctcgttcaacgctcttccttgagcaaatctcggcacggcgcctagctagctaggtacaacgcgcggtccgcacccgctccagccccacccgagccatgggccgtcaccgagcgtaggtaacgccaaaaccgctacgatcccgcctctggggcacggatctgcgctggaggttgaacgccaagctaagcggagtggcggcgcaccagggtcggctcgtagatcaccgagctgacccgggccgccgggtcgtcgatgcgcaggagcaggagtttggcggcctcggcggccatgtcctccagtgggtggcggaccgtggtgagggccgggcgggcggccagcgccgcgctgctgtcgtcgaagccgacgaccgcgacgtcctccgggacccgtttgccggcatcccgcaggacgagcagggcgcccagggccatcaggtcgttggcgacgaacacgccgtccaggtgcggctcggcggccagcagggcgcgcatcgcgcgctcgccgctgtcctgggtgaagttgccggccagggtgggcacccaggcgtggccgtgccgggccatcgcacggcggaagccggtgacgcggtcctggctggccgggacgtcggcggggccggagatcatggcgatctgccggcagccgcgggcgaccaggcggtcggcggccagcgcggcgccggtctcgttggccaggtcgacgtagctgatcgggaccggctcgggtgggcggccgatcagcacggccgggatgccggccgcggcgagcaggccgggcagcgggtcgcgggccggcagggagagcaccacggcaccgtcggcctggccgttgcgcagatcgccgaccagacgtttgtgaccgtcggcgccgaccatctgcagggccagctgggtggcggcggggcgcagcacgctcatcaggccgccgacgacccgaccgaaatacgggtcggcgaagaagcggctcatgaacgggtcgtcgtcgtgggtctccgagtcggagacgaccagggcgatcgtgccggtgcgccgggtgaccagcgagcgggccagcctgttcggcacgtagccggtctgctcgacggcgctccagaccagctcgtgcaactgcgggtcgacgttgcggacgccgttgacgactcgggagacggtggctctcgagacgcccgccacccgggccacgtcctcgagcgtcggtagccgctggctctgcatgcccgcagttatagcacggctggagagcgctttccgcggccgttgatcgaaccgggacaaacaggggcactcgacgttccggaacggaaaaccattgacgtcggtggtaacaccctcgaaaactggaaagcgctctccaagcgtatcgtccgccaaccttgggagatcccccgtgaacagaagaacgctccgcaggctcgtggcgcccctgagcgccgcgctgctggccggcgcctggctggtcgctgtcatccagccggccagcgccgccgacaccctgctgtcgcagggccggcccgcactcgcgtcgtccgtcgagaacggcgagtcccccgccatcgccgcggtcgacgggcgctccgacacccggtggggcagccagtgggccgacccgcagtggctgcgcgtcgacctcggcgccgccgccacgatcacgcaggtcacactgcagtgggaagcggcgtacgccaagtccttccagatccagacctcgcccgacgggaccgcctggaccaccatctacagcaccaccacgggcgccggcggcacacagacgctgagcgtcaccggcaccggcaggtacgtgcggatgtacggcacccagcgcggcaccggatacggttactcgctgtacgaattccgggtctacggcacgtcgacggtcaccccgccggccaccgacggccccggctacatcatggcgaacccgccggtcaccggcgtgatcccgtccaccgcgaccccgcccgcacagaacccgccggtcacccaccacgaattccaggcgaactgctcggtcagccgcacgaacctcaccgacgacccgatcgtcttccccggcctgcccggggcctcgcactcacacaccttcctgggcaaccggaccaccaacgccaccaccacactggcgtcgctgcaggccggaggcacctcctgcatcacccccggggacaagaccggctactggatgccgaccctgctcaacggcgacaccgcggtgcagccggacggcccgcaggtcatctactacaagagtggagtgctcgactacaccagcgtccggccgttcccggccgggctgcgctacgtcgtcggcagcccgaacgcgaccatcgacgaattccgcaacaacccgggcgccgtcgaaggcttcgagtgcggcgacagcacccgcaactgggacatcccggcgaactgcgtcgccggatcccagctcaacgtccgactgcaggcgccgagctgctgggacggcatccacctggacacgcccgaccacaagagccacatggcgtacccgatcgtcggcgtctgcccggccgaccacccggtcgcggtgccgatgatcgagttcaagatggcctggccggtcagcggcaccatggccaacgtgcacttcgcgagcgggcgaggctactcgttccactacgacgtgttcaacgcctgggacgggccgacgctcgcggcgctgaccacgcactgcatcaacggtgggctgcagtgcaacccgcgcggtttcgaccagtacaagccggaccggggagccgcgctcaacgagaactacgaactcccgtaacccaccgaccgcccccggccggggtgacagcattgactgccctcggccggggcgcttccaccgacggtcaaaagcaatatcgacaacgaatttttcccgtacgttttcagcactatttcttgagcgccccgagcgccgccgcgcggctttgcagaatgctcgccgcgagtgccctcgtgcgcgtttccgcaccggccgactgctcgctgccggccagctgccggctctgctccaggtactcccgcagcgccacgccgagggtccggtcgaacgcggccccgtgctgcccggtcgccgcggcgagcatcgccggcgtcaccatcccgggcatcggcatcccctcgtgcggattcccgccggacagcccggcctcgtcgtgcagcttgcgcagcgtgccgagttccctctcggaaagcgccctgacctggtcagatactgctcgtaacccggtgtccgccccgttgctcggggtcagcgcgagcagcggcagcagctgctcgtccatcgcgatgttgatctggatccaggcgatgtcggtgccgccgaagcttgccgcgggggtgcccggcggtgggccggcgggtggggtggtagcggtgggggagccgcaggcggtgacggcggccagcccgcaggcggccgccagggcgccgaggcggcggcgtgttctcacgtcgcggagtttccagttccggaaccgtgatgtcaatgccgagtattgacgtccggcaacacgagagaaacaatcgctctcgcttggagagcgctttccctgttcgattccggagcaggcccccgtccgcaacattccccgttggggtgatcatgagtcaaatatccgcgtccggtccgcgacgccgccgaccgtccctcgtcgccgcggtcgtcgcgctgctgctcggcctcgccgcggtcgcggtggccaccgccgcgaacgccgccgacaccctgctctcgcagggcaggccggccaccgcctcgtcccaggaaggcgccgacgtcggcccgggcaacgccttcgacggcaatgccggcacccgctggtccagccggttcaccgacccgcagtggatccaggtcgacctcggcgccgccgccacgatcagcaaggtcgagctgcggtgggagggggcgtacggcaaggcgtaccggattcagacgagcagcgacgggacggcctggaccgacatctacgcgacgaccagcggcgccggcggcaccgagtcgctgaccgtcagcggcagcgggcgctatgtccggctctacggcaccgcgcgggcctccggctacggctactccctgtacgagttccaggtctacggctcgctcagcaccggcacgccgggcgccgactgcacgacgaacgccgcgcagggccagccggccgccgcgtcgtcggtcgagggagcggacgtcagcgccgacaaggcggtcgacggcaacaccgggacccgctggtccagccagttcagcgacccgcagtggatccgtgtcgacctgggcgccaccaagaccctctgcggcgtggtgctgcagtgggagggggcgtacggcaaggcgtacaagatccaaacaagcccggacgggaccacctggaccgacatcttctccaccggcaacggtgccggcggcaccgaggcgttgacggtcagcggcagcggccgctacgtccggctctacggcaccacgcgggcctccggctacggctactcgctgtgggagttcaaggtgctcaccggcggcgggacaaccaccccgagcacgccgcccacgcaggatccgacgaactacacgacggtctggcaggacgatttcgacggtacgtcggggaccaccccgtccgccgccgactggctgctgcgcaccggcaccgcctaccccggcggggccgcggcctggggcaccggtgaggtcgagacggccagcgcgagcaccgcgaacgtgtccctcgacggcagcggccatctggcgatcagggcgctgcgcgacgcttccggcaactggacctccggccgcctggagacccggcgcaccgacttcgagccgctcgccgggcagctcaccaggttcaccgcggtgctcaggcagcccgacgtggccaacggcctgggttactggccgggcttccgagccaccggcgcggcgtaccgcggcaactacaccaactggccgggtgtcggcgagaccgacatcatgaccgacgtcaacgggcgcagccagctgtcccagacgctgcactgcggcaccgcccccgacgggccgtgcgccgagtacaacggccgcaactccggcttcgcgtcctgcgccggctgccagaccggctaccacgagtactcgcaggtggtcgatcggaccaggaccgacgaggagatccgcttctacctcgacgggcggcagagctgggtggtgcgcgagtcgcaggtcggcgtcgcggcctggaacgcggccgtgcaccacggcttcttcctgcgcctcgacctggcgatcgggggctcgctgccgaacgcgatcgccggcagaaccacgccgacggccgacacgaccccgggcggcgtgctcagcgtcgactcggtgaccgtgtcccgggccaccggcaccacgccgacggccatgaccgaccccgcgatcccggccgggcccagcgtcgtcaaggtgaccggcagccagggcaactggaagctcaccgtcgacgggcagccgtaccagatcaagggcctgacctacggcccgccggcccgggccgccgacggctacctgcgcgacctgaagaacatgggcgtcaacaccatccggatctggggcgtcgacgacaccgataccccgatcctgctgaacgccgcggcccggcagggcatccacgtgatcgtcggggagtggctcaaccagggcgccgactacgtcaacgacaccgcgtacatgaactcggtgaagacctcgatcgtcaaccaggtcaacgcgctcaagggcaacccgggcacgctgatgtgggacgtcggcaacgaggtcatcctcaccatgcaggaccacgggctgtccgcggccgacgtcgaggcgcggcgcgtcggttacgccaagttcgtcgaccagctcgccgacgcgatccacgcggccgacccgaaccacccggttacctcgaccgacgcgtacaccggggcgtggccgtactaccggcagtacgcgccccacctcgacctgctcgcggtcaactcgtacggtgcgatcggcaacgtctacgacgactgggtggccggcggctacaccaagccgtacgtggtcaccgagggcggcccggccggcgaatgggaggtgccgggcgacgccaacggggtgccgaccgagccgagcgacctgcagaaacgcgacggctacacggccagctggaacgcgatcaccgcgcatccgggggtggcgctcggcgcgaccgagttccactacggcctggagaacgacttcggcggcgtctggctgaacaccttcaccggagggtggcggcggctcggatacggggcgctggccaaggcgtacaccggcagggccctggcgaacaccgcgccggagatcaccgcgatgaccgtgtcgaacccggcggcggtaccggccggcggcacctacacgatcacgaccagcacgacggatccgaacggcgacctgatccgctacaacctgatgtactccgacaagtacatcagcggtggcaccggcctgaccaacgtcagtttcaccgacaacggcaacggatcgttcaccgtcaaggcgcccgagacactcggcgtctggaaggtctacgtgtacgccttcgacgggcagggcaacgtcggcatcgaaacccggtcgatcagggtggtgccgcccaccgtgaccggcaccaacctggccaagggcaggcccgccaccgcctccgggtaccagccgaccggcattaacggaccccagctgccgtcgtacgcggtcgacggcgactacggcacccgctgggccagcgaatgggtggacaccgcctggctgcaggtcgacctcggctcggtgcagtcgttcgaccacgtgaacctggcgtgggaggcggcgtacgccacggcgtaccagatccagacgtcgaacgacggcaccacctggaccacggcctacgcgaccaccaccggcgacggcggcttcgacaacctggcgatcaacggctccggccgctacgtccggatcaccaacacggcgcgggccacggcgtacggctactcgctctacgaattcggcgtctaccggcagtagccacatcgggggagggaacgcgcccggcgggccggccgggcgcgttccccgtgcccgcgtgcggtacgcatagtgccgtgcacaccgtggaactgctgctcgatgcgggacgggaagacgacgtacgccggcagtgggagctcttgcgggacgccggcctgcccagcctcgccgatcatcggcaccccaccaaccggccgcatctgaccctggtcaacgccgcgtcgctggctgggttgcccgacctggacctgccggtggccgccgcgctcggtccggtgcggatgctcgggagggcgctggtctgggcggtgacgccgaccgaggagttgagggaactgcatttccgggtgtggtcggcgctgccgcaggcgtggccgccgccggaccggtggattccgcacgtcagcctggcactccggtttcccgcggcggcggccgccacgatcactccggcggacgtgcgcggagagttcgtggcggcgcgcagctacgacaccgcaacgcggtcggtgaccggcctctagaggaggctcaccgggtgctggcgcgggcccaggcgatcagcgccggctgaccgagcaggcgcaccgcccgcttgcggtcggtgtccaggccgaagctgtccttgcgctcgacgaactgggcgatgttgcccggaaacaccccggcgaagaacgcggcggccacgttgcccagccgccgccgggccggctgacgccaggtgaccagcagcgccgtccccagcgccagctcggccaccccggacaccaccaccacccggtccgggtcgaccgggaaccaggacggtacctgcgcctggaactcctgccgtttcgtggtgagatgcccggcgcccgcggtgaggagcaccgcgccgaggccgacctgtccgagagttcgcagcagactcatgccttcacgatctccgatcgccgcgctttccaccacccgcccgggtgaccgcccgccccggcagtggctcaccggctgccgggccgccgccattttccttcggcggcgcgctgatcgggggccggggtgggtactggatccggcatggcgggggtgcgggtgggattgtgcggggcgagtatggcgctggcctcctatgcgcagcgtttcccggtgctggaggtgcagcagaccttctacgagccgccccgcgagagcaccctgcggcggtggcgggacaccgtgccgggggagttcgagttcgtcgtcaaagcgtggcagctgatcacgcacgaggcccggagtgcgacctatcggcggttgcgcaccccgctgagcgaggcggaacgggccgaggtcggcgggttccggtggacaccggtggtggcgcgggcctgggacaccacggtccggtgcgcgtcgctgctgcgggccggcgcgatcctgctgcagtgcccggccagtttccggccgaccgagcccgccgtgacccggttgcgggaattcctcgcccgggccccgcggccggacggggtgcgactgctgtgggagccgcgcgggccgtggccggacgacctggtccgggacatctgtgcggccggcgatctgacgcacgccgccgacccgttcctgcggccgagtctgacgccgacggcctattaccggctgcacggcgtgaccggcgcccgccacgtccacaccgatgacgagctggcgcggctggccgccatggtggacggcgggccggcgtacgtgatgttcaacaacctggcgcgggccgacgacgctcggcggttccgccggctggtggccggcgacgcgcagcacaccggatgatcgacgtggcgccggcgtggctagtcgtcgtcgcgtaccgcgccgggccggtccgggccgggggcgatcaggctgtgggcgatgttgcgggcgaccgccgcgagttcggtgtcggtgaccggcaggccgcgcgaggccatcagcacgatgttgacgctgagcagcgccgagcggacccgtagcgtctcctcgacggtggcgtccgggccggtcacgatgtcgaagagttcggtcatcttgccgaacgcgttctcccgcccctgctgctggtgcaggtcgcggacgacgtgctggttggccatcgcgaacttcatggcggccatgccgctgccgacgccgagctcgaccatccggtcgacgacctgggcgcgcagctccggcccgggtggctgctcacgggcccagtcgacgagctcgtcgagcgcgtccaggtgcgcctggaagatcgacaggacgatgctctccttgctgctgaagtggtagtacagcgccgccttggtgatgtccagccgttcggcgatctcccgcaggctggtcgcctcgtagccgcgttcggtgaacagctcgatggccaccctgcggatctccgctttggtgtcggcgccgcgccgctgtcctgatgtcgccatgaccgtcctcacctcggggtttgccagcttaccgtgcggcaagtaaactactgaccggccggtaggctacgcagcaaccataccgaaagaagtcagccgtgaccccacccacccggttcacccatcgagagatcatggtgaccatgagcggcctcgtgatcgcgatgctgctcgccatgctcgacaacatgatcgtggcgcccgccctgccgaccatcgtcggcgagctgcacggcctcaaccacctggcctgggtgaccaccggctacatcctggcctccacggtcgccaccccgatctggggcaagctcggtgacctgctcggccgccggatcaccttcctcagctcgatcgcgatcttcctgctcggctcggcgctgtgcggcatgtcgcagaacatgggcgagctggtcggcttccgggcgctgcagggtctcggcgccggcggcctgatggtcggcgtcatggcggtgctggccgacatcatcccgccccgcgagcgtggcaagtaccagggcgtgatgatggccgtcatgccggtcgcgatgatcggcggcccgctggtcggcggcttcatcaccgaccacctcaactggcgctgggcgttctacgtcaacctgccgctgggcgtcgtggcgctgggtgtctgctggttcgtgttggccaagcttccgcgcggcgcgggtgcggtgcgcatcgactggctcggcgcggccctgctcagcgtctggatcaccgcgctggtgctgatcaccacctggggtggcagccagtacgcctgggcctccgcgcagattctcggcctgctcgcgctcgcggtggtcgccttcgtcgcgttcgtcgtcgtcgagcgccgctccgccgagccgatcatgccgctgtccgtcttcgccaaccgcaacttcgcgctggccggcgcgctcagcctgatcgtcggcttcgccatgttcggcggcatcaccctgctcccgcagttccagcagtacgtgcagggttcctcggccaccaacagcggcctgctgctgatgccgatgatgctgtccgccatggtcgtctcgctggtcggcggtcagctgatcacccgcaccggccactaccgtgcgctgccgatcctgggcaccgtgttgatgaccgccggcctcgccctgttcgccaccatggacatcggcacctcgcggttcaccaccggcctgttcatggcggtcctcggcgccggcatgggctgcctgatgcagaccaccatgctgatcgcgcagaacagcgccccgatccaggcgatcggcgcggcgaccggcgcggccaccttcctgcgcaacatgggcggctcgctcggcgtctcgctgctgagcacgctctacaccaaccacctgatccacgcgctgggcggcggcgtgccgaccggttcggccgccgggatgaccccggccatgctgcgggccctgccggacaacgtgcggcacctgttcgcccaggcggtcaccgacggcatcggcgccgcgttcacctggggcgcggtcgcggccgcggccggcatcgtggtggcgctgttcatccgccacgtgccgctgcgcggcttcgccgacgcaccgaaggccccggagcaggccgccgaggagctgcaggcggtctagacggtcaccggccacgagccgccacgatccggcaacggaccgtggcggcttttccgattgcggcggtacgccgtcggcagccccgcgtcctcagaacgcgtagcggacccggcagtagggcgtgcgcgcaccgatcagatcgaccagctcagccacgtatcttcctttctccccggtccggtaccgcacgttccacgacccgttctgcgaccgtttcggctgctgcagctccggccgccagatcagctcctcggctttcggatgccagcccaggttcacctcgtgcagttcccgattgtgggtcaggaaaatgacctcggctgccagctgccgtttggccgcatcgccgattccggcatcgagctgatcgagcagttccgcccaatcctgcagccatccgtcgcggacgacgaccgggctgaaattgacgtgcacctcatagccggccgccacgaaatcgtcgatcgccgcgatccgctcggccaccggcgaggtgcggatgtccagcaccttcgcatccttcgcgggcatcagggagaatctgatccgggtccggccctggggatcccagccgagcaggtcccggttgacgtgcttggtggcgaacgacgccttcgcggtcggcagccagcggaacaactcgaccagatcccgcacgttgtcactgatccgcgcgtcgacgctgcaatccgaattctccccgatgtcgtagacccaggcgaccggatcacattcgttcggcgcgctcttgacgccctggcgcttcgcgtgccgcgccacgtacccggtgatcttgtcgatgttggcgaagaccgtgatcggattgctgtagcccttgtgccgcggcacgtaacagtaggcgcaggccatcgcacacccgttggcggtggacggggcgatgaaatcggcgctgcgcccgttcggccgggcggccagcgtcttcttgaccccgagcaccagcgcttcccgtttgatccgcacccaccggttgacgttcgtctcatccccgtagagctccggaatccggtggtgcgactccacctcgaccagctgcgccccgggaaaccgggccagaatctccttgccgcggggcagttcggcggcggccggctcgacatagatccggcggatgtccagcagctcgctcacaccccgagtatccccttaatctccgcggtcggggtgaaccccgatgaccgggaagccgcgtcgcgcctacggtttcgaggtgacccgccgactcgtgctactgatcatcggggcagccgccgtggtgctggtgccgtggagcgtctatctcgccgacaccctgccggaccggtatgcgaccggccagtggcgggcgacatgggtgggtttcgacctcgccctggccgcctgcctggcgatcagcctgcggctcgggctgcgccggcgtccggccgcggttccggtgctgtccgccaccgcggcgctgctgttctgcgacgcctggttcgacatctcgctcgactgggcgtcgtccgacctggccgtcagcgtggtgctggcgctgctggtcgaggtcccgttcgggattctgctactggtctgggcccggcggctgatcagcggcggcatgcgccacacccagctcacgatgcgccacctgcgggcccgggaggatccggaattcgaccggacgatggtcgcgctggaccgtctcggcccggccgactgccgcaccatcgccgccgcggtcggggtcagcgaggcgcaggtggggctgcaactgcgcgaggccgagcagctgaacctggtcgaccggcggcgggacggccggtggctgctgcccgcccatcagaacctgcggctgccgtccctggaggccgcccgggacggcgaggaccgcgagcggttgctgcggttcctcgacgccaagtaccgcagcgagctggagttgctggcctgggcggtcgagcaccacgccgagttcggccggtggggccacggcgagcgcgccgtcacccatctcagcggcccggagctcgccgctttcatccgcgagtatcaggagctcagcaaccggtactgtctgctgcgctcggcgccgggcccggacacgcgggaggtcgcgatccggtggtacgccttcccgaagccggctgatcagcccgccctcgtgtccgttccgcacacgtccggggccacaccgctctccctctcgcgatgatgcggcccgggtgaaatccggatgtggcggcggcgccggttccgggatcatgtcggtgtgcccgcattgatcgcgcccaccgggcgtgtacgtcagtcgttcctcgccgccatggccgagttccgcgccgaggggcgcgccggccccggcgaccagtccatgatcggccgggagtggcgcgagttcggcgaccggtggcccaccccggagggcttcgccgcctatgtggaccggctgctgtccgagccggtggaggacaccccgcgacccgaggggttcgtgccctccaccaccctgtggtgggtcgacggcgacgagtacctgggccggctggcgatccggcatcgcctcaccccgcagctgctcgacttcggcggtcacatcggctacgacgtgcgaccttccgcccggcgccgcggccacgcgaccgccatgctgcgcgccgccctcccgctggcacgcgcgctcggcatcagctccgccctggtcacctgcgacgtcaccaatgtcggctcccgcagggtcatcgaagccaacggcggcgtcttcgaggatcagcgcgccgagaagctgcgcttctgggtgcccaccacctgacggtccgcgggctgccgccgacagccgaagccggctctggacagcacgacgggcacggcccctggccggcgcccggccggaacagcgattccctccctgccgcggggggacggactcacggcccggtgatcgttgcctggtgcaggcgggtcgcggtgtggatcagggtggccagtggccgggagcggctgtgtggcggccaggcgatcaccgtggtcaccgggggtgcgtccaggaccgggatggtggccaggccctcgcgcaggtgggggcgggcggactcgggcaggaccgtgcagaggcggccgagggcgaccagctgcagcagctgggcgtggtcgcggatctccgggccgggaccgtccgggtaggtgccgtccgggcgtggccagcggggcaggggcaggccgggcaggttgcggagctcggccatgcgcaggtgcgggcgggtggtcagggggtggccggcgggcaggaccgcgatctggttctcggtgccgagctcttcggtgtcgaggcccgcggtggagtcgaacggcaggtggagcagggcgacgtcggcgcggccggcgcgcaggacgcgttcctgttcggcgatgccgcacagggctacttcgacgggcaccgcgccgggttccgcggcgtatgcgtcgaggagtttcgccagcagctcggtggtggctccggccttggtgaccaggaccagtccggggcgtccggcggcggcccggcgggtgcggcgttcggcggcctcgaccgcgtccagcgccacccgggcctcgcggagcagcaccgcgccggcctcggtgagggcggcgccgcggtggtcgcggtcgagcagggtgacgccgagccggcgttccagccggctgatcgcgcgggacagcggtggctgggcgatgccgaggcgctgggcggcccggccgaagtggagttcctcggcgaccgcgacgaaataccgtagctcccgcgtctccatgaccacagggtatgaccccgccacccgatcggtattgggccccggccgccggcgcggacaggatcgggtcatgagcgaaacgagggtcgcgctggtcaccggcgcgaacaaggggatcgggtacgagatcgcggccggcctgggcgagctcgggcacaccgtcgcggtgggtgcgcgggatgccgggcggcgcgaggaggcggtggcgaagctgcgggcggccggggtggacgcggtcggcgtgccgctggacgtgaccgacgagggcagcgtggtggccgcggcggaactcgtcgagcggcggttcggccgtctcgacgtactcgtcaacaacgccggggtgaccggtgggcggccgcaggagccgacggtcgtcgatcccgccgtgatccgcacggtcgtggagaccaacgtgatcggggtggtccgggtgaccaacgcgatgctgccgctgctgcgccggtcgccggcgccgcggatcgtgaacgtgtccagcagcgtcggttcgctgacccggcagtccacgccgggcgccgagaccgggccgatcagcgcggcgtactcgccgtcgaagtcgttcctgaacgcggtcaccctgcagtacgccaaggagctggccggtaccggcatcctgatcaacgcggcctgcccgggttactgcgccaccgacctgaacgggttccgcggccaccgcaccccgcagcagggtgccgccaccgcgatccgcctggcgacgctcccggacgatggtccgaccggcggcttcttcgacgacggcggtgtcgtgccctggtgaatgagatatctcacgccgcggcggcaccgggatcctcacgtgcgggccgacccgaccgaatggaggggccgaacccattccacccggctcgcgaggtgtctccatcatggttgctgcggtctcttccaccgtcgagctgcccgccgtcggcacgccgatgtttctcgtcctcggtgaggggatgaacttccggtcgcgcctcgaggcggtggacggtgaccgtttcacggtcgccgcgccgttggagaccgccggcccggtcgtgatctcggccggtcagcagttcgacgtcttctgggcgccgccgagcacccggatcgtgctcccggcccggctggtcgcggtctccgacgaggcgccgttccggtggagtctcaccgcggcggggctcccgcagcacagcaaccgccgcgagttcgtccgcggtggtggtggcgccgccgtccggttgaccaccgacgacggtgagatcgagggcgccctgctggacatcagcgagggcgggctgcgctgctggatcgacgagccggcggcgctggccgcgggcgggcggatggcggccgccgtcacgctcggcgccgcgggcacgatcgaggtgagcggcacgatcctgtcggtccgcgaggccccgtacggcgatccgggccggcatgtggtgctgacgttcgacccgcgggaaagcgcggcccgggcgatccgccgctacgtgatggagtgggagatcaacgagcgccgtctccaccgggacgccgcctgatcctgtcgtcgcaggtcacggaccgggcggtaccctgccgcccatgtcgcatccggtgcagttgctcggttccgcggtgtcccggtggggcgctgatccgtgggcgctcggctcgtggagcctgatcggccggcacggcggcccgcgggaccgggtcgcgctcggcacgccgatcggcggccgggtgcggatcgcgggggaggccacccacgcgacgcgcgccgggatgacccatggcgcgtacgagcagggccttgccgcggccgcctgggccgcggatcgggggcatgcccgcgtcgcggtggtcggcgccgggatggccggcctggccgcggcccgcgcgctcaccgatggtggcgtcgaggtgacgatctgggaggcgcgggaccggatcggcggccggacagccggggtcgacgtcgccgggggcgccttcgatctgggcgccaactggctgcagcagtacgacgagaacgtcctcgcgcggatcgccgaggacctcggtctcaccatgatcgtgaccgatttcaacgatccgctggtgctgcgcggcgagccgttccccgacggcctcgaggacgatctgcgccggcgtctggcctcggccgcgccggacgcgggcatcgccgacgtgctcgacgcctggctgcgcgatccggccccgtggaccgccgcggagatccatcgtttcgtcgccgccgagatcgtcatggacgccggcgccccgctgtcctggctgagcgcccggcacggcttcgagccgggcgtcggtgagggcgaccgctggatcgccggcggttaccgtctgctcgttcgacacctggcgaccggaatcgacgtacgtcttcggcacccggcccgccacctcctgaccctgccggacggcgtggtcctgaccggtgacgccggcaccctgcgcgccgacgcggccatcgtgacggccccggtgccggtcctggccgccggcgccatcaccttcgacccgccgctgccggagccgcaccgcaccgccctgtcgcggctgggcgccggccgggtggagaaggtgatcctgcggttcgaccggcggttctggccggagcacggctactaccgggtgcacggtccctccgagctctgcatcagcgagtggctggacgccagcgccgccgacggcgtcccgaccctggtcggcctgttcgccggcccgtggctggacgacctgtggaccggcaccgaccgggaggtcgccgcccgcgccgccgaggtgttccgcgccgcggtcgggtagaagcagcggccgggcgcggatcgcggccgggtgcgactcggcccttgcgcggccggaggacagtgtggggaccgatcgaccacgcgatcgaccacgtgaaggggcatgccgatgacctcgacccgttggaccgcgggctgcctgacggtcgccgccgtcctcggcctgctcgccgccggcgtcttcctggtcgacgaccaccagcgcggccggatcgtcgaccagggccatcaggtgcgggccgtggtcaccgccgaccacgaggacgagttcgaccactggtacaccgtcgactacccggtacagggcaccacccgcagcgccgacctgcggtatccgtgggtgatcgacaccttcccggtcggctcggagctcaccgtctacgtcgacgcggaccgtccggagcggatcgccaccgcggacggctactccacgccggtgtgggcctccgccccgggcttcctcgccgtgctggcggtcgccgcggcgttcgcctcgaccgcgggcttcgtcagcaaccggaggagctcctgaacggctgacccgatccggcggacagtgggcgccggatggcagactgcgcgcatggtcttcgaggtggcggcgttccgtgagcacttcccggccctgcggcacggtctggcgttcttcgacggcccgggcggcacgcagacgccggccgtggtcgccgaggcgatcgccgcgacgatgaccgcgccgctgtcgatccgggggacggtcggcattccggacggcaacgccgagcgggccgtccgggagttccgcgccgcctatgccgacctgctccacgtgccgccggccggcatcgtgcacgggcgcagcgccacccagctcacctacgacttctcccggcatctggccaagacgtggcgggccggcgacgagatcgtgctgagccgcctggagcacgacagcaacgtccgcccgtggatccaggccgccgaccgggccggtgtgacggtccgctggatcgagctggacccggccgccgcgaccctggacctggactcctaccggcgggcgctgtccccgcgcacccggctggtcgcggtcgccggcgcctccaacgtgctgggcgccaaaccgccgctgcggcacctcgccgacctggcccacacggtcggcgcgctggtctacgtcgacggcgtgcacctggtcccgcacgacctggtcgacgtcccggcgctcggcgcggacttcttcgtctgctcgccgtacaagttcttcggcccgcactgcggcgtgctcgccgcccagccggcgctgctggagacgctgcggccggacaagatcctgccgtcctcggacgaggtgccggagcgtttcgagttcggctccctgccgtacgagatgctggccggcgccaccgccgcggtcgacttcatcgccgcgatcgcccccgggcccggatcgagccgccgtgagcggctggcgcactcgatggccgccgtgcacgagcacgagctggccctgcgcgcccggctggaggcgggtttggccgcgctgggcgacgcggtcacggtgcattccacggccgccgaccgcaccccgaccaccctgatgacgctgaccggccgtgatgcccgcgcggcgcaggtccacctcgcggctgtgggggtgctggctccggcggggtccttctacgcgtacgaacccttcaccgccctgaagatcaccgacccggcgctgcgcgtcggcctcgccccgtacaacaccgcggccgaggtcgaccgcttcctgaccgccctgaccgacttcctgtcgtgacgctcgcggctccgcgggcgggctctagctagctagggccggggcgagatcgcggaaggtggcagccgggagcggggcccggcctaagctgaaccggaccatcccggatcagccgcatgccgccgaggtgacacggtgcacagcattcggacaaggctggtcaccagcgtcctggtgaccgtgctgatcgccgtggcctcgctggtgaccatcgcggtggtgatgacgcgctccctggcgttgcgtcaggccggtgactacaccgagcagctggcgatgcgacagtccgcggcggtcagccgggtgatcgacgtggcggtgcacgccaccgaggagctggccggcacgctggcgcggctcaaggagtccggggtcaccgaccgccgggtggtgaccgatctggtgggcgcggcattgcgtcggcatccggatttcttcggcatgtcgaccgggtgggagccgaacgcgttcgacggccgggaccgtgacttccgcaaggtcgcgcccagcgacgccaccggccggctgatcccgtactggtaccgcgacggggaccggctgcggaccgacccgctcgtcgactacgacaagccgggcgccggggactggtatctccagccgaaggcgaacagcaagagcctggtcgtcgacccgtacgtgtaccaggtcaacggcaaggacgtcctgatgaccaccgcgaccgccccgatcctgtccggcggccgtttcctcggcgtggtgacggccgacctggcactggccgacctgcgcaccgcggtgaccgccgagaagccgtacggcaccgggtatcaggcgctgctgaccgcgggtggtgccgtcgtcgcgcacccgctggcggacctgctcggcaaaccgctgtccgaggtgagcgcgcaggtcggcgccgcggtcagtggccagcggccggtgcgctggagcggccaggacccctatctgaagtccgcggcgacggctgtggtggcgccggtgccgctggcgacgggtgactcctgggcgctgctcgtcgcggtgccacacagcacgatcaccgccgccgccgacgacatgcgccgcaacctgctgctggcggcggggctggccttcctggcggccggcgcggtggcctgggcgatcggtaccggcctggcccggccgatccaccggctgcgcgaccggctcgtcgagatcgcggccggcgacagcgacctcacccagcgggtcgaccaggatcggcgggacgagatcggtgagctgggcgcggcgttcaaccggttcaccgccaagatcgcggacgtggtgcggcgcatcggggagaaggccgagggtgtctccgccgcggccgacgcgctgaccggggtcagtgagcggatgcgcggcaccgccgacgacagcgccggacgggcggcgcaggtctcggacaccgccgaccaggtctccgggaacatccagacgatcgcggccggctccgaggagatgaacgcggcgatccgggagatctcggccagcaccatggaggcggcgcaggtcagcctgcgggccgcggaggcggcgcaggccagcacggccagcgtcaccaagctgggtgagtcgtcgaccgagatcgggcaggtggtccggctgatcacggccatcgccgagcagaccaacctgctcgccctcaacgccaccatcgaggcggcccgggccggcgagaccggcaagggtttcgcggtggtggcgggtgaggtcaagcaactggcccaggacaccggccgggccaccggggacatcaccagccgggtggagacgatccagtcggacgcgctcgcggcggccgacgcgatccgggagatcgccgaggtggtggaccgcatccacgagttgcagagcaccatcgccagcgcggtggaacagcagacggccaccacgcacgagatgacccggaacgtcgccgaggccgccggcggctccgcggccatcgccggcacgatcggcgcggtggcggacgcggtccacgagaccaacgtcggcagccaggccaccggccgggccgcccaggaactggccgaactcgccggcgagctgcggtcgctggtcggccagttccgggtctgaccgcgccatgcccgctcagcggagcgggaggccggagcggagctggtcgaaggcgcggttggccgcctcgaccgccgccgggtagaggtcgtcggcggtggcgccggcggtcaggcgccgccagttctcccgggccaggacccgctggaccgccaggatctgggccgccgccagccgcgccgtcagcgggtccggcgtcgccgtcgccaggctctcggccaggctccgctcgtcgcgcagctgatagtcgtagaccctggtggccaggctgggtgtggagaagaccaggtcgtggaaggcgagcacctgcggcacgtcgttgagtccggtgaccgggtcgcgggtggccagcccgtcgaggaaccgccggtgcagcgcatcgagcggggagcgcccggccgggcgggaactcacggtccgggccggttcgccggcgtggtcggcgaaccggtgcaggaccaggtcctccttcgacgcgaagtaacggaacagggtcggcttggagatctccgcggccgcggcgatgtcggtcaccgacacccggtcgaagccgtgttcgaggaacatgccgatggcgatctcggagaccgtgtcgaaggtgcgctgcttcttgcgctgccgcaggcccgtctcgctcaccaccacaggctagcattctggttaaatttgtaaccttgtaacttttcttaccaagtaagggagcgtgaccagaggcgccgggcaccgttctcacccgggtttccgcgtcccggcggtcgtgttgacgtacgctgatcgtctcctgccgttgctgaagtccaccgtgccgcagacgcggtcggttcgcggtgacgccgagctcaccgtgagtcgcgtgccggacctggccaccgcggtcaccgagcggctcggtgcggcgccgtcgagccggccgagatcgtcgccgccgagccgcgcggccaccaccgcctccacgtggtgctcacccgcgcggtctcccggatggacgtgctgcacacgggtgacctgccggtctgagtacttgccgggttgccttaccttacgggcatcacacctggagagaacatgcgcctgacatacgccctcgtcccgattctgatcatgtcgctggccgcctgcggcgacaagaaggtcgccgcgccggccgcgaccccggtcacgaccacgaccacgacgaccgcgaccgccgagtcgggggtcgcccccgcctcggccaagccggtggcggctccgaagagcccggccgtggtgaaggcgaagccggccggctcgtccaatccggccttcggcatccagtacgcgctgctcaagtcgagcaagccggccacccggcagatcacctacgacctgatcgagtggtacgagggcaaggaggccaccaaggcctgcgccgaggacggggtcaaggacaccgacgacgaccagtgcaccggctggtacatccggaacaacaacacgaagctgcgcaccctcaccgtcgacccggacgccaccatcaagctgaccgtcgagggcacgctgaagtccgtcgacctgaagacgttcctggccggcacccacccggacaccgtcatcaagttcaccatcgacgcgaaccggatcgtgtcgctggcggagatcttcctgccctgagcggtttatcccgaaccgcgcgtggtagccgggcgtcgtgtggcgctaccacccggccctcgacggcctccgcgcgctcgccgtcaccgcggtcctgctgttccacgccggagtccccggcgtgggcggcgggttcctcggcgtcgacgcgttcttcgtcctgtccggcttcctgatcacttcgctgctgctcgacgagcaccggcgcaccggccggatcgacctcggacggttctggcggcaccgggtccggcggctgctgcccgccctgctggcgatgctcgccgcgaccgtcgtggccggacggtacctgctcgacccggacgcgctcggactgctgcgcaccgacgcctgggccgcgctcggctacgccgcgaactggcggatgatcttccgcggcaccgggtacgtggcggtcacggccaccccgtcgccgctgcagcacacctggtcgctggcgatcgaggaacagttctatctgctgtggccgctgctggtcgccggggtgctggtcgggctcgccacccgcaccgcccgccggttgctgctcgccggctgcgccgccggcatcatcgtctccgccctgctctgcgcggcactgttccagccggcggcgccgggccgtgcctatttcggcaccgacacccgggcccaggctctgctgatcggcgcggcatccgctgtgctgctggcccgctccgggcgtgcccggtacgtgggtggcccggtgcccgtcctggccggcgtcgccgccaccgcggggctctggcacctggcgtccgaacaggcccgctggatgtatcacggcggcctgaccgccgccgcgctcgccgccgccctggtcgtcaccggtgtggtcggcgaccccggatccgggccggcccggctgctcgccctgccgccgctggtctggctgggccggatctcctacggcgtctacctgtggcactggccgctgttcaccttcgccaccacggagaccaccggcctgtcccgctggccgctgctggccgtccgtctcgccggcgccctggccctggcggtcgtcagctatcacctgatcgagctgccggtgcgacgcggtctgctggcccgcaccctgccgcgtcacggcccggccgccgtcaccgcggccgccgccgcggcggtcctgctcaccatcggcctcagcacgctgctagctagctagtgatcccgccgatcccggccgcgccggcacaccgcaccaccggccggctcccggcgcccacccgcgaaccccgggtcaccttcctcggcgactcggtgtcctggacgatcggcacctacctgcccccgcaccccggcatgtggaccagcgtgcgcgccatccagggctgcggcatcgccaccctgcccgacatcctgcagcagggcaccccgcacaccaactatccgggctgcaccgagtggccgcggcgctggcggcaggcggtgatcaaggacagcccggacgtgtcggtgatcctgctcaaccgctgggagctgatggaccgccgctaccagggcggctatcagcacgtcgggcagcccggctacgacggctacctgaccgaccggctggacctcgcgatccaggccgccgccacccgcggtgccgcggtcgccctgctcaccgccgcgtacacgcaccgcgccgaacgcagcgacggcagcctctacggcgaggaccggccggaccgggtcgacgcctggaacagcctgctgcgccgggtcgcggcccggcacccgggccgggtcaccgtcctcgacctcaacgcggtggtgtgcccggacgggcgatacaccgccacggtccacgggctgcgggtgcgcagcgacggcctgcacttcaccccggccggtgtgcagcaggtcatcgccccgtggctgctgccccggctcgccgccctcgccgtcggcggtgatcgcgggccggcgggtttacccgggtcccgaccgggaaggcagcgctcatgagtaccgaacagcaagccgcgggccggcatcccaccgacgagccggacggcacgcccgcctacgcggcctccctgcgccgtcccggcgaatcggttgccggggcgcccgccgaggagcccgagcccgacgaggcaccgaccggcgccggctacgacgagaacgcggtgtccggcgacagcaccgcctaccgccccgactgatgcggtcgcgccgggttcgctgcatcggaccggacggcgcgggtataggagcgatcatgaatgatgtcgatcccgagcagtacgacgaggacacccccgggcaggagcgcgtcccgaagcgggacgcgcaggaggcgcacggcggcagcatggcgcccgggctggtcgacgacaccggtcaccgcacggccgagccgttgcccggcgccccggtcgaggagccgcgatgagcaacgcaccggaccggaacgaccccgaccgcgcccgcggcctgatcagtgacgcccagggcgagttcgtccaggagcaccccggcggcgcgttcgacccccgcgcgttccgctccggccaccccgccccgccggccgagccgccggccgcatcgcatccggcgggcgagccgccgatgcgcgggaaccggatggcgccacccggcgaagagtccgccaaggcggaataggcacaggtttcaccggccgccgatcccgctggcatggctgacgtggtcggcggcgaagccctgacacccgacccgatgtctcgcgacggcgacgcgtgggcgcccggcctgtcgctgacctgcacccgcatcgcctgacggtgcgcgcggccgacgaccgttgaccgcatcgctgccaccgggcgaacagtcccggtggcagcgatgcggagcgtcgtcagcgctgcagggtgagcaggcccggacgccacggcaggttgttgtagtcgccgccggcgttggggtccttgccctgatagagcaattgcaggtggcacgggtcgacggtcttggtctggtccggattctcccggaccaggtccccgtggctgatgtcgttggtccaggtggcgccgctgttggccgtgccggcgaacgggttgctctcgctggcggcctgcggggtccaggagccgccgaggctgctcgcggtgaacgaccggaagtagcggccctgactgccgatcgcctcgacgatcatcaggtactggttctgtccctggaccttgtagacctcgaccgcttcgaacaggttgttggtcgagtcgctcatgaccgtggtgtacgaggagccgaagctgcccgggaagttgccgatcggcatgctcgcccggtagatcttgccgttgtccccggcgaagaacaggtacatgttctggtcgtcaccgatcagcgtctggtcgatcaccccgtacggcgcgtcgggcagcgttccggtgaacagggtctgcgcgctggaccagccgttggcattggtcgggtcggtggaggtcttgtagctgaacgacgtcggcccccactggtaggccagcacccagatgttcttcggcgcgaagtagaagagggtgggcgccacggtgccctggctcatcccgttctgcccggccgaggccatgtccgaccagttggtgaacggggtgaaattcatcgagccgtacgacccgttggacacgttggacgcgtacaccaggtgcttgccgttgtagacgacgttggtgaagtccttcagcgaggtccagccgttcttcggctgcgcgagcgcacccgtcgagctccagcggtacgacgacggcagcgtgcaggtgctgccgctcggcgacggcgtcggcgagctggtgccgggggcggagtaggtgaattgctggttggcctggccgttgcagtcgtacagctggacctgctggccgttggcggtgccccagacgtccaggcagcggccggactgcacgccggtgatggtcccgttggcgttgacgttccactgctggttggcctgcccgttgcagctgtagatctggatcgccgcggagttgccggagccggcggcgtccaggcacttggtgccgtacaccgtcagctgcctgttcgacgtgtacgtccactgctggttggtgccgcggttgcagtcgtagagcgtcacgcgggtgccgtcggtctgcgaccggttcggtacgtcgatgcaccgccccgactgggttccccggatctctcccgtcccgctcggcggggtggagctgccgctcggggtggggccggcggcgttgagcgcgtcgaggaccgaggtgtaggcggccttcttggtgcccgaaccgtcgaacagcagcgggttctcactcgaccgccacgagtcgctgtcccgcacaccccacacggtgacgcccaggcagcgcggcacgttgacgcaagcctgggtgagcccggcgtactgcgaggtggacgcgttggtgacgtcggcctcggtcagcgcgacgtccacgccggcgttggcgaagttggtgagcgtggtctgaaagttgccgggcagcgcactgccgccggtgaagtgggtctgcagcccgacgcagtcgatcggcacgccgcgcgacttgaagtccttgaccatggtgagcacggccagggtcttggcgtacgtcgcgttctcgatgttgtagtcgttgtagcagagcttgaccgacggatcggcggcccgcgccgtgcggaacgccacctcgatccagtcgttgccggtgccctgcagattcgactgccggcggctgccatcctcgttgtacgcctcgttgaccacgtcccaggcggccagcttgcccttgtagtgcgccatcacgccgttgatgtggtcgatcatggcctgacgcagcgagctgccgctgaggctctgcatccatccgggttgctggccgtgccaggccagggtgtggccgcggaccttcatgccgtgctgggtcgcccagttgtagatctggtcgccggcgctgaaagtgaactggccgcgctgcggttccgtcgcgtccggcttcatctcgttctcgggggtcaccatggtgaattcgcgtcccgcgatgccggtgtacgtcgcatcgccgagccgccccgccgcgagggcggtgccgaagtagcggcccgactgggcggccgcggcgccgagggtgctcgccgccgcactcgcgccggcgctgaccaccaccgaacccgccaccgcgacgaccgcgacgacaccgccgatgagcatcttgagccgtaacggccggcctcctggggagcctgcggggtggacaggagggctggttgtcacatcggcctccgtttcggttctgcgttccggcccggagcaccgcgagcaggggccggaatgccgccggcggggtgcggaaggcatgccggtgcaccgcgcgtcctgagcgagaacgaccagagtcaatatttccgcaatgctggcacggtaatcgcgctgaaacaatagttacgaagaacttccggaatccagatgcgacagtacgacgatcgtcagccggttcgggagggctcctagctgcggcgatggtgggatcatcggtggatgcgccgtcggtgatgggcatgctggcgaggccagtgagacgcgacggatgtaatgcatcgaaagtttcggagccgttgaggggggtcatctattggcggccgtaatcttcgaatcgtatgtccagaactgttatatccgtttgtcacggaaagtcgacaccgagcctgctcgaccccggctcgcatcggcgtcccgccggtgatcgatgtggccgagcactgtcgcgacacaggcctccaacggtcgggccgtgtcgacgagcagggcgtccggccagggcgggaacgccgcgagccgggccttcgcgtccggccagtcgccggcgtcagcccagccgggaatgccgcgcacccgggtctccacccgctcccggtgcaaagactccacgctgcaggcgcagaccaccgggatgaacgcggcgccggccgctgacgcgagactcgcccagcgggcccgtacccccggctcctcgctcgtcgtgtcgaggatcgccgagcgtccggcggacagctcccgataggccagcgtcgtcagcagttccgcaccgatgctcatgaggtcggtgcggtgccgcatcccgaacgggctcagtgcacccatcagccagtccagcgcgaacaccggcacgtccaacgccgccccgacacggtcggcgaccgtgctctttccgctgccgggcaccccaccgaacacgatcagcgccgcgccggacctggatgtcatcggcacgccggtgaagtccgccggcaggccgggcgtgagatagtccggcacccagcgctgcgtatgggtcagcgtgatccgatgtggcacctcggccccgacctcgacgtgcgacacccacaggtcgtcgtcgcgggtgcggaatcgggccgtggccgctgtcccgtcagcgtcgacgccgacgacgcggatcggggcgagcccggccgcccggctgccggtgatgtcccgcagtgctgaggcgccgccgatccccgccgcgaatccggggtccaaggcgccgtcgacgtcgacgtcgacgggccaccgtccgtcgagtccctcaagcaaccagcgcagtcgcgtcaatgccggggtgccggccaccagatcgtccatgcgtcgagtctggacgggcaccggatctttcaccttcccgcgggttacgcgaaaagcgtatccgccccggcaacccgatcatccgaagctcctgctgccggcgcctactccaacggcgatcgacctgcgttggtcgcacgcggcggctcggacgccgcgcaggaggtgggcgccatcagcggcagatccggacgctggccggggccgagcccaaatccgtcatccgaatgggggaacagttattgcgctcatcggcataatgaagaggtggactcggagacctatttcgccgcctcggctcagatacttccggctttgatgattcccatctggatcgagaatattcatctcgctcggcaacgcgcgttgagaattatggcagcacgtcgacgaatcgaggaactctgggagagtggtaagggaaaggcaagcggggacttcaccacgaggctggaaattctttcgcgaagtttcgacaagtcgcgcaatcgccaccgtggtgggatcgtgttggccgtcgtctcctcggtggtgttcatcctcggcgaagcaggcgctatctatcccttgcttgagccgcatactcgtcctgggtcctttgatgtcagtgaaccagcgaaatggaccacggtcggcgccattgcgctactttctgtactcgttgcgttctttccatttctcaggtatccgagaacgggatcgcggaaagatccggaaggataccgaccgcagccggtgaataccaccgacgtgcagtgggaattgccctgatgcaccggaccgccattgtcgaggcctgccgtcgcaccgtccccgccccgaaggtgatggttctcaggggaacctggcgtcaccgggatgtgaagaagctccggcagtctgcgaggtcgccgtaggagacgatcgcatcgtcgatgtcgttatagtcgtcactgacctttgcgattgtggcattcacttggttctgaaggccatcggagacggcttgcgttttggcctgaccctgctgctccaatagggtcaagagaaggttgacatcgacctgtatgcggttcaatgaattcatcatagccttgatgtgctcctcatcctcctcgggatatggagctggagcccatttggaatagagtgccttcaacgtgttctccgctgccgttgtccatcgaacctgggcggcgatgccgttatccggcgcttccccggccctgtcgagctgtgcctgcgcatcccggcaccactggttgacctcggcgacataaatgacgtgttccggtgaaggcttcgacggcggagtcgccgaggggccggcgtgtgtgctgccgccggtcgagtcgccgtgggcctgaatgccgaaaaagactgtcgccgcgacgccgaccacgccgaccagcacgccggcccagctggcgcgatcagcgccggtggatcgaccgatggccacgatcagtacacccgtgatggcgaccagaacggagatcgccaggagtattcccatcgtcggaagatccacccaatcttgtattctcgctggtcggccaccgctggcgcatcagatgacggcaccgttcagcacagatttctccggccgtgggccgcggtggcgatggatgcgttttcgccgaagatccggtggcggccagcttcgcgaggttcctgtcgtggccgtgaccatatgggcagactgtcgctacggccatcggccgaccgacggaaagcgttcgttcaatcgcctggcgatgatccatttccaccatctgtatctccctacgtgtcgcccaggaccgtagcctgtgcgagctaccgacgacgcggtgcttgcccattcaggaaaatcatgacagtgaagtcgctcctttgtcgcccggagcctcactcagttgtgggcgcggctctgaaatgatcttggcttcggaagagtaggcctgaccccgtgcggtgcggacagcagttttcgcctaatcggcgggtccagctcagggctgtttggcgcattgcacaaaagatagctggtcgtccttcggtcggacggcaatatctcatcgtcaacgctgtggaatcgaggcggcagtcgcagtattggccccctctgatagagtggcccgccgtgtctgattcaagctcttattccggcgtcgacctgcccgcacccacacagccgccgctcatgtcccacgggactgcgccgaagcggcgaagcgtcacccttctcgcgacagccctcgtggcgctggtcgtcggggccgctggagccacctcagtattgctgttgtcgggctggcgtaaacccgcagaacagcggtacaacgtttccttctttctgaagcagagcgtcacggcggcacagacgtcagcgatacggacagagctggagaaggtccccgccgtcaaagacctgcgatacgagtccaaggaggaagccctcgcaaagttcaaggaaatgtacaaggataaaccggagatgattgaagcgatagaaaagtcgggttcggataacggcctgcccgtgtcgttccgcctggatatgaaggcttccgatttcgattgtcgaaccatggaggcgatacgtgcgctccccggggtggagcaatacagtgtcgtcatgggatccatcgatgagaacccagtcctgcaggttcgctgccactgatatcggctcatcgcttccgacgtcgccacttcgccgccggggcctttcagcggcttgcggcgatgatcgacgaggtcaccggtcacgaatcacctcggtgctggccgaagtcgtcatggcgtcccggacggccgagtctcgctggccatcgctcggcaacaggcattgagccataccctccaggccggggtcaaccgctcgcgaacgaccgctgcgacccgtcactgcaccgtaggaccggccactcagagcaggatttccacggcgtcagcgacggtgacgacggtcctgtcgggcgcgagcgcggccgggttgctcagcggcgggggtcggcgtggaatttcgggccggggccggcgccggccgggcggttgccggcgaggacgtcgacgatctcgggcagggtgagggtggcggcgaccagtctgcgcggggcggtgggcttcgcggcgtacgccgcaatcgctccggaaagacctgaggaggcgccgagaatgccgacggtggtgacgtccttgagcacgatgtcgcgggtgtcgaccaggctgggcgagccggcgagaccgatatagaccacggtgcggccgggttcgaccaggtgcaccgcgaggctcggcacggccgccgcgttggtggcgtcgacgaccccgtgccagggcaggtcgggcagggtgtcgcgggtccacaccggggtgtcggcgagcggctcgtcgccgaggccgagcaggtgcacctcggcgccctgggccgccccgaacatggcggcgagcaggccgatggtgccggtgccgaggatcagcaaccgttcgccgggggccaccgcggcggcccggaccgcgcgcagcgcgttgccgcccggctcgaccagggcacccagcgtggcgtcgaccgggtcgggcagcggatgcagataggccgccgggaagagcagccgctcggccagcgcgccgggcaggccgtcgcggcagcccagctcgtgccggtcggggcagacgtggtgccggccggagcgacagcgtgggcacgcgccgcagccgatcatggtgtcgccggtgacccgccggccgagccagctctcgtcgacgccggggccggtggcgatgaccgttccggcccactcgtggccggggcgcagcggatacgacgcggcgccggtgtgcaggtagctcatctcgccggtgaacagctcgacgtcggtgccgcacaccccgacccgctcgatgccgaccaccacctggccggggccggcctgtggctccggcacgtcctggacctcggcccggccgggatcggtgaagacgagcgcgcgcatggtcgccagcgtagagcttgctcccggccacttccgcccgtgggatcaccattcctgacgtgccgggaaaacggtacgtttcctcccggtccggtaagccgggaagttcgcggaaggaacccgatgacgagaatcgacagcaccccgttcggcgaggcacccgacggcacggcgatcgagaagtggacgctgaccggcgcgagcggggcgtcggtgtcggtcctcacctggggtgccaccatccagtcggtgatcgtgccggatcgggacgggcggctgggcgaggtgacgctcggcttcgccgacatgagcggttacaccgacccggacaatccgtacttcggcgcgaccatcgggcggtacgggaaccggatcggcggcggtacgttcaccctcgacgggcaggcgtacaagctggccgggaacgagggggcgaatacgctgcacggcgggctgcgcggtttcgacaagcgggtctgggcggccaccgaggtcacggacggggtgcggatgacgtacaccagtcctgacggtgaagaaggttttcccggcgccgtcgagacggccgtgaccttcagcttcgacgacgagctccggctgcggatcgactatcacgcgacgaccgaccagccgaccgtggtgaatctgaccaaccacgcgtactggaatctggccggcgagggcagtgggacgatcggcgaccatcttctgcagatcaacgccggccattacacgccggtcgacgcggcgctgattccgaccggtgaactggcgccggtcgagggcaccccgttcgatttccgcacgttccacgcgatcggtgaacggctgcgcgacgacgatccgcaattggcgtacgggcggggctacgaccacaattatgtgctcgccgaccgggtggcggcgatcgtccgggacccggcgaccgggcggcagctgaccatcgagacgaccgagccgggcgtgcagttctactccgggaacttcctcgacggtcggctgcgcggcatctccgggcggcagtaccggcagggtgacgcgttcgcgctggaaacccagcactacccggacagcccgaaccagccgcatttcccgtcgacgacgctgcggccgggggagacgtacacgtcgagcacgacgcacacgttcggcgtcttcggctgaccgttcggcaggtcgtggcgcggggagccgccccgcgccacgaccgctacccgacggccgccaggaagtcggtgtagaacaggccgaggccgatcgccgcgcagaccccggccacgatccagaaccgcacgacgatgttgacctcgctccacccggccagctcgaagtggtggtgcaacggcaccatccggaacacccgccgcccggtggtccggtaggagacgatctggatcacccaggtgaccgtgatgatgacgaacaggccaccgatcaggatcgacagcaacgtggtacgggtggccaccgcgagtccgccgatcagcgcgccgagtcccagcgagcccacgtcgcccatgaaaatccgggccggcgacgtgttccaccacaggaagcccaggcaggcgcaggccgccgcggccgcgatcatcgcgatctccagcggatcccgcacctggtagcagtactggccggggcgggcgtacgtcgggtcggcgcaccagtgccggtactgccagaagccgatcagcgcgtacgcgcccagcaccagggtggacgcgccggtggccaggccgtcgaggccgtcggtgaggttcaccccgttcgacatcgccgtcaccacgaaggcgaacaccatcaccgagccgaccttgccgacgtccagccagtcgaggtcacggatgaacgagatgtgctcgctggccaccgtctggccgttggtgctccgcacgtagagcgcggcgatgccgaacccgacacccacgagcgcctggccgagcagtttgcccttggcggacaggccgtcggagttgcgccggcgcaccttgaggaagtcgtcgaggaaaccgaccaccccgcagaagacgaacacgccgagcagcacgagcgccgtcatggtcggcttctcctgcgcgatctgccgtttcggcagcgtggtcagcgcgaagtgcccggcgacgtaggcgacgagggtcgccacgatgaacgcgaccccgcccatcgcgggggtgcccttcttcccctcgttcgaggccagcccgagagagcggatcggctgcccggccttgagcgcggtgaagacccggatcgccaccggggtggcgaacagggagacgaggaacgcgaccgccgccgcgacgatgaccgccctcacgggcggccctgcaggagatccggattgcccacggggcacgatcttgccatctgccggcaagcgtcggtgggagcctaggctgggccgggtggagacgaccccggcgcaacggttcgcgagcgcgcgggtggcccggctggccacggtcaccccggacggcgcgccgcacctcgtgccgatcgtgttcgccctggtcggggacgtgatccacaccggggtggacggtaagccgaagcggtaccgcaacctgcgccggctggtgaacatcgcccgcgagccgcgggtcagtgttctcgccgacgggtacgacgaggactggtcgcagctgtggtgggtgcgtgccgacggcgtcgcgacggtcagcgacgagccggagcccgcgctgatcgaccgttacccgcagtatcgggtgtcgcccccgcccggtccgttcctgcgcatccgggtcacctcctggcacgcctggtccgcgacctgaggtgccggcgggcaccggtcacgccgggccggtgttgaccgcgccgtgcaggaacaggtcgaccaggtcggggacgggggtgtggcggccggcgccgcggcggccgaagaacagggcgaggaaggcgtcggtggcggtggcggccgggacgcgcagggtggcctcgtccggcgcgaacaggttgagaacggcctgccgggtggcggcccgggcggcttcccggtcgccggtaccacccgccggccgggtcgggtcgacggcttcggtgcccggccgccggttcggggtaccggaggcgtgcacggccccgacgacggcgcccatccgggcgaagtaggcgtcgagcgcgtcgaccgcctcgaccagccggtcggcgaggggctggtcgacggagatcgaccggagctcgccgagcacggtggtcgagtccatggcggcgacgatgcacgcgcccaacagctcgttcttgtcggtgaagacgcggaacacggtggcctcgccgatcccggcggcgcgggcgatctgcgcggtggtgacggcggcgccgtgctcggcgaccaggggcagggcggcgcggacgatcatctcgcggcgttgttcggtggacattcccggcgcgcggcgccggtcactctcggctgtcatgccgatcagagtacggagtgagtactcactccgtcaaggcgggcggcgattggacgggcatcgacgcgggacatagcatgtgccgaccatattgatcatggttgtcaccagcgggggaatgccttgtccgagagttcgtgccgcatctgccaccgggcgcccgccgcggaggtcaccttccacgggcacgagggcatgatcgtgctgatgcgcttcagccgggtgcacggcccgttctgccgggagtgcggcctcgcggcgtaccgcgacatcaccggacgcacgctgctgcgcggctggtgggggctgggctcgttcttcgtcaccgccggggtgctggtgctcaacacggtgcggcgcgcccggatcgcggcgctgcccgaggcggaccgcccggccaacgaccggacgctcgatccgggaaagccgctgctggaccgccccgccgcgtacggcctgctggtgcccgcgctgctgatcatctacgtggcgttcagcaccgcccggtcgtgaccggcgggggcggctaccgcgccgtgttggccctgccgtacgcggtgcgcaccttcgtgcccgcggccggcgcccggctggcctacgggctgttcccactcgccaccctgttcaccgtccagcaggccaccggttcgttcgccaccgcgggcctggcctcggccggcttcggggtctagctagctagcccgcctggccgaccggcacagccagcgcgccgtcctgccgccgctggcgctgacctgtgccgcggccctggcgggcgcggccatggtcacccggcccgccgcgctggtcgcgctgatcaccgtggccggcctggccgcgccgcccctggggccggcgatgcgggccacctggcgccggctcacggccggcaccggtctcaaagcccgggcgtacggtctcgattcggtcgtcgaggaggcgctgtacctgaccgggccgttgctcgccggcctgctggtggcggccgggccggcccgctgggctctgctgctgaccgcggccctgctgctggccggcaccctcggcatggtcgccaccccaccggcgcgggaccggcggccacccaccggcgacgacccgggcggccatcggtggctggtggacaccgggccgctgcgctcgcctgccctgcggggcctggtggtgacgatcctggcggtggggaccggcaccagcgcggcgtacacctgcctggccgccttcgccgaggaccgtggcgccccgggagcggccggcctgctggaggcggcgctggccgtcggcagtgtgaccgggggcctgctctggggccgccgcgaacacgcgggccggcgtcacctgcgccatctcgccctgctgaccggtgtgctcgcgaccggtctggccgtcgccgcggcggccgccgggctgctcatgctgggtctcgtcctgtgcctgacgggtacggcggtcgggccggtctatgtggtcgcctatctggccgccgacgacgccgcgcccgacgggtccgccaccgaggccggcacctggctgaacgtcgccgccacggcgggtggggcggccggcgccgcgctggccgggacgatcgccgagtcccggggtcccggcccgggtttcctgaccggcgccgggctgctggcggtgaccgcggtggtgacggccgtacggtcgcgccgggaagcggtgagtgcccccgacgccaccggttgatctgcgggaattcacgcatctgaacgcggacggccgcccgcgggccgtagattcggcgcgaaattcctacggcggaggcaggtcgacatgtccctcaccgcagacggtgcgacgggtcgccgcgggccatactggacggaaagcgtccgctgcccgcccacgtgaccgtccacctgttcgtgatcgtgcggttcgtggcgctgctcgcggccgtcccgttcgcctggggccgagggttgagccggctcgatctggcgctggccgtcggctggtgcacgctgacctgcctgggcaccacggccggtcaccaccggtacttcacgcacggctcgttcaaggccgggcgcccgctgcggatcggtctcgcggtcgccggcagcctggccgtgcagggcgccgtgaaccggcccaccgcggcccggctcgcccgcatcacccgctgacgcctcgtcccgtagaggttcaccgccaccacctgcaagccggtgctcgaccattccgcctaccgggtgcccgtcctcgatgaggcgccacccggaagccgctcgacccgcacccgttccacggtggtcatgccgatcccgaacggcctgcggacgatcgcgggcgacgccggcaggcaggtgcccacccgtgcggtgcgcggggccggttctactgtgagcaagacggccccggcgacatcgacggcgtcgcgcgcggtgccaaccgcacctgcgacgatgacggctacagcccgttctccctttgatcgcacttcctgtcggtcgttcccgtcgcgggggctggcacagtggagtgatgaaccgcgcggcgggcgtcgacatcgtggtgcgggagctgtcggcagcggacgacggctcgttcgcggcccgggtcgagttcggtgactccggcggcgagaccgtgaccgtccgcgcgcccgtcgacgacggcgacgagaagctgctggcctggtatttcgagcagcacctgcagttcccgttcctggaccgggacctggagcggcaggccgccgaggtggtggcggaatacggtcgcgcactgttccggcaggtcttcgccggcgaggcgagatacggctaccgccgcgccttcgaccagggtttccagggctgccggctgctggtgcgcgggtcggcggccttccagcggctgcactgggagacgctgtgcgatccggagcggggggagcggctcgcgctgcggatgccgctggtgcgccaggacacccgggtgccgctgccgtaccggctgcccgaccccgcacccacgctgaacatcctggtggtgacggcgcgaccgttcggctcccgcgacgtgggataccggacgatctcgcagccgctgctggacgcgatcggccggacccggctgccggtcaccgtcgacctggttcggcccggcacctgggaggcgctgcgcgagacgctgcggacggccgcgcgcgaccacggccagggctggtatcaggtggtccacttcgacgtgcacggcgggttcgggacggccgaggcgatgacttccggggtgacctccgggcgctacctgttcgagccgggcgagcggcccgccgacgcgcggcagggattcctgttcttcgagaccggcacggtgggccgggcacggccggtgccggccgatcaggtggcgcagctgctggccgagcaccgggtggcggtggcggtgctgaacgcgtgccagtcggcgatgcaggacggcggcgaggccagcctggcgcaggacctggtggcggccggggcgccggtcgcgatcggcatggcgtactcggtcacggtcagcgccgcccaacaggcgatgccggtgctgtacggccggctcgcggccggcgacgacccggtcgttgcggcgtacgaggcccgccggccctgcacgacgtgaaagcgcgtcgcggacacttcgaacaggatctcgatctggaggactggatcctgccggtcgtcttcgcccagcgggagtcccggctggacctgcggccgatgaccgccggcgagcaggaggtcttctaccggcgtcgcgagcaggtgagcgtggcgcccgcggtggattacggtttcgtcggccgtgacctcgacctgcacgccctggaacggctgctgctgatcgatcctgagcgcacccaggtgctggtccgtggcatggccggggcgggcaagtccaccctgctcgcgcacgccggctggtggtggcagcggaccggactgatcgagcaggtcttctccttctcgtacgagcagcgggcctggacggccgagcagatcacccgccagatcgcgcacgagctgctgcccgcgccggagttcgcggcctgggagtcgctgggcccggcggcccggaccggcctgatcatcgaccggctgcgcgccacccggcacctgatcgtgatcgacaacgccgagtcgatcacggccagcccggcggcgatcccgcacgcgctcccggagcgggaacgtgaccggctggcccgcttcctgtccggcctgcgcggcgggcggacgctggtgctggtgggttcgcgggaggccgaggagtggctggcgacgtcgacctttgccggcggcgtccaccacctgccaggtctggatccacaggccgccacggccctgttggagcggatcgtggcgcggcacggcggcagccggtggctgggtgacaccgtcgatgacgagcagcgtaaggcgctgagcgagctgatgcggttgatcgacggctatccgctgccgatgacggtgatcatgccgcagctggccggcacgccgccggcccggatcctcgccgagttcggcagcggcggtgatgccgtcgatccgtcgatggccgctcgtcgtgcgatcgaatacagccatggcaagctcgacccggctctgcaggagtccattctcttgctggcgccgttcaccggtagcattccggttccggtgttgcacatttacgtcaatgagttgcgcgccggcgccggggaagtgaacatcggggaagttgatctggccggtgcggtcgccgagctgcgtagtgtcggcctcgcccgtgcgcatccggagttgactggattcgtggagaccgtacccatcctcccctactttctccggaatcgaatccgcggtgatccggacctggagcgggtgtgtcgtcacgcgcattaccgcctttacgtcgactgtgccgctttcatgcaggatgccgttctttccggtgacccctatcggcgcgcgctcggccgtgtaatggtcaaggccgagtatgcgaacctcatggcttccctccactatgcgcaaggggcgggggagccggtcctgtccgtcgtccgcgccctcaacatgtacctcgatgtggaacatcagcacaacgtccgccgggctctgctggagcaggcgatagagcgactccccgaaccggaaaccgccgacgatcgatgggaattgttggatctgcacaacattgcgggcaacgcggccctgacgcaggggcaactggacgacgcaacttatcattaccagctggaattggacatgaagcgggctctcgggctccgcgagtatgaggccgtcaccctcaaccagctcgggaagattgcgcaggagcagcgccgttttgcggaggcgaagcagtatttccaggactccatcgacatcagcctggagcacaacgaccgcaaatctgcggccacttcctaccaccaactcggtatggtcgcgcacgaggaggggggcctggaagtagcggaagactattatcgacaggccgccgatctcatccgtgagtccggtgctcggcaggaactcgcagccccctaccatcagctcgggatcattttttccgataagggggaatgggatcgcgccaatgaattcttcgaacagtcgctcgccatcgccaccgaattcaacgaccggcacaagatggccttcacgtaccaccagctcggtatgtccgccttccagcagggatcgctcgacaaggcggtctactattaccggttggctctcgatatcgagatcaactctggtgatcgaatcggcgcggcgagcacctaccaccagctcggtctggtcgcggtggcacaacatcgagtcgagcaggcggaacagtactttcagcaggcgctcgacaccttcgtggatctgggcgaactgtccgggtgcgccgtcgtcggcttccagctcggtgatgtgatatgcctctccggccggcacgacgttgctttcgtgcacttcatccggtccatcgtcgcctacagattgagcaggggaatctgggcggtgaatgtgcttgaccgacttcacgaggaggaggggcacccgatcgaccggacactccagcaggcgattgcggacctcgtcccggtggagctgcggggcgagttcggagaggcttttcgtcagcgcgccgccaccccgggtcgaggcccagcggatcggccctgacccactcgtgtcgatcaggttatcgtcgggtcatggagaaacgggcgacgctcgccgacgtggcgcgggaggcccgggtgtcgcgggcgaccgcctcccgggcgatcaacggggcgtacggcacctccccggagatgcgcgagcatgtgcgcgcggtggcccggcggctggggttcgagccgcacgcggcggcgcgggcgctggcgaccgggcggggcgggggcggccgccgcgagcggatcgagatcctgatcgtcgatccggatccggcggcgatgggcgtcaagccgttctacggccgggtgctggccggggcgatgaccgcggtggacgggcaggacatcgcgctggaggtgcgccgggtggacgtgccgccggccgcggacgacgatccgccgttcggacgcctgctgatcaacatctccggggcggccggggcggcgtatgcgcgccgcggtcggacggtggcgctgggccgctgtgcgccgggggtcacgttcgtcgcgccggacaatgacggcggcgggttccaggccgccgcacacctggtgatgagcggccggaaacgggtcggcgcggtgttcgggccggcgacgccgtgcgcgcgggaacggcgtgccgggttcctgcgggtgatgtccggggccggccgggaggtggtggccgccgacggtgacttcacccgggcccgggcgtacgcggcgaccctcgaactgctggaccgcgccccggacctggacgcgatcttcgcggcctgcgacgtgaccgcgatgggtgtgctgcaggcgttgcgggcctccggccgccgggtgccggaggatgtcgcggtggtcggtttcgacggcagcgccctggccgaggccgccgacctgacctcggtgttcatgccggccgaggatgaggcggccgcggccgtccggcatctgctcgacccggcccggccggcgccgcggcggctgccgacgacgctgaccgtgcgcgggtcgagctagctcaggccacgatggagcgcagcgggataccggcggcgcgcaggtcggcgatcaggtcgcgcagatacgggtgctcgtcgaactgcaggccgtccgggttcgggatggtcaggtaggccgagtcgccggctaccgccaccgtcgccgtgctcgtgtaccggctcaccacgctccgggtgcgggccaggtcggccaccgccacctggatccggtccggccgccactcgccgcccaggttcggcgccgccggccgcgcggccgcggccgccctcgccggttccggtctcgccgtgcgcgccgccggcttcgggttcccggccgggtacagcagcgcgttggccaccagctgcatgccgctctcggtgtacccgcgaaacagcgggtcgttcgcgaacagcaccgcccgccccgccccggtcggctcgtcgaccaccaccgaggtgcccttgagcacgtcctcgtgcaccgtgtagccgttgtgccagaatgtgccgtcgctcggataggtcagcacgttcacgccggtggtgctcggggtgaggatcgggtcgccgttgttgaacgcgaagtccgcggccggccggcccgtgccgaccgggctggccgggttcacgtcgacccgcaggtgcgagccgatcaccaggtagtcgtcgggctgcggcttctcggtggtcgaggtcagcccggcggcccgggccaggcgggtgccctcgttgcggagaccgacgtaggtgtgccccgcgccgatccaggcccgcaggttggcctgtccggcggcggtcagtccaccggtcgggttgctgccgtcgggcaccagcagcacgctgcgccgggtgaacgcgggcgtgttgtcgttgatgtcggcgctggtcaccggggtgaggttcagcccccagcggctgccgagcaggtagcgggcctcgccgtacgagccggacgtggtggacaccccggcgccgcggaacagcccgacgtcgggtgtggtgagcgcggtcccgccggtccgcgcgctgggcgtcagggtgacacccaacgatcgggccagccggtcgacggtcggggtgaccgccgaggccggtacccgcaccagattcccgtcgcggaccgcggcgattccccgaccgagcaggcggaaggtcaactgcgccgccgaggcggaatccagcgggtacgtgtagacccgcccccgcccgctcgccccgccctcgacgccggtcaccaggctgccccgtgggcgcacatcgtcaccggtgtagacggtgtcgatccccatcagcagcggattgctccacgacgagacgtcgtagaaatacgggaacgggacgtacggatcctcgcccagcgtcgcctggatccagtgcttctgcggctgatccatcgggatccagtaggcgcccttcggaacaacgacctcatcggccgtacgcccgccgaagatccgtgcgtgggcgatcgtgaccgccttgcgcacctcgtacacctcgacgtccatccgccgcagccggtcgaccagccgtcgcacgtcggcgagctgcctgcccggcatcaggaaatacgaccggactcggatgtcgggcaccgggaaccgcacctggttctccggctgcaccacctggttcggctccagcttgccggcgcggccctcggcgaccgcgtcactccacgtccggtagtagccggtcagcacctcgcgccggttcgccgcggcccagcccagggtcgcccactgggtgttgtactgctgctgcacccggtcctgcaccgaggaggcactgcctttctcgtacgtcattccggccgccccgaatccggtcgccggaaccgtgtcgccgtaccccatgtagaacaggtcgtacgtgtcgtaattgaaatagcactcggtggtgacggtgtcgctgcacgccccgttgtagccgaatgccgccttgttcgccgccccgatccggttgatccagtccaccggcgcgtccgcgatctcgtggtggatcgggtcggcgtccggcgggaagaaataccgctgtccgcccatctcgtgcgcgtccacgaacacctgtggcgggtatttccgcagcagttccagtttgctgtcggtctccggctgggtccgcgcgaaccagtcccggttcaggtcgaacccgtactcgttctgccgccggttcgcgtcccgcccgtccgggttctgggtcggcaggatcaccgtgatcaggttgtcgtcgcgctgccgcaccgcgcaggacgtgcccgcggccagctcgtacagcgtcttgaggctggcgtccgcgccactggtctcgccgccgtgcacgttcccggcgatccagacgatggccggctccccggccgcgatccgccgcgcctgctccgccttcagtttccgaggatcccgcagctcccggatctgtccggcgatccggtccaggctgcgccgggagacgtgccggctgctggagacgatcgcgtagtcgagcggctgtcccagcacgctggtccccatggtgccactgaccacccggtcggaagccttgtcgacggccgccaggtagccgcggatctcggcgttggtgaccacccgctgctggccgatgccgagcgggaagccgaggaaactctccgggctgggcacggtgcccagatacccggccgcgccggagcacgacggtggaccggccgccccggccggcgccggcgtcagggccgcggtcagcaggatcaccgctgccacggtcgcgggtctcggaattcgcatcgtatgcccgttcctttcccggaaaacgcaacaaatgaccgcagcctaaagcggctatttatgctggtcaatgaactgcggtcatcgcgttcccgggagggtggtcggcggcccccgtcgctgccccaccatagcagaggtatgcggcgaaaatcggcctttgtccgttctggcgtcgctcgctgcccaccggcgcgaagaaggtccgcgtactgccgcgcctcgcgctccggccggatcggccggagcccggtcgccgctcgcgcttcccgcccggagcggagagatccggttccggaaccggctcggctttcgacaaatgtcgatgtcttgtaccgtggtttgggagcgctcccactcctcgttcaaggagactcccatgcaacggaagcaccatgccctggtcgccgccctcgtcctggtggcgtccgggctcttcgggctgacgctgtccagcccggcgcaggccgacaccaggatctgcgaccagtacgggtcgaccaccatcggcggccggtacgtcgtgatgaacaaccgctggggcaccagcgccgagcagtgcatcacggtgacgggcaccgggttctcgatcgccagccagcagggcaccgggaacaccagcggcgcgccggtgtcgtacccggccgtctactacggatgtcactacaccaactgctccccgggcaccaccctgccgctgcgggttagcgcgatcagcagcgcgacgagcagcatcagctacaccttcgtgtccggggcgacctacgacgcggcgtacgacatctggctcgacccgcggccgaacaccaccggcgtgaacgctcaggagatcatgatctggttcaaccggcagggctcgatccagccgatcggctcccgggtcgccaccgccaccatcggcgggcgcagctgggaggtgtggcagggcagcaacgggtcgaacgccgtggtctcctatgtggcgccgtcgccggtgagcagctggagcttcagcgtcctcgacttcatcaacgacgtgaagaaccgcggtgcgatcaccagctcgtggtacctgaccagcatccaggccggattcgagccgtggatcggcggcgccgggctggccgtcaccaacttctccgcggcggtcgacggcggcggcgcgccgtccggtccgggcaccccgtcgagcccgtccaacccgggcacttccggttgccaggtcacctacgcgccgaacgtgtggaacaccggctacaccgcggacgtcacggtggccaacaccggtggtggggcggtcaacgggtgggcgctcggcttcaccctgccggccggacagacgatcaccagctcgtggaacgcgacgctgagcggcaactccggggcgatcaccgcgcgcaacgtgagcttcaacggcgcgatcccggccggtggcagcacgtcgttcgggttccagggcgcctacagcggctcgttcgccaagccggcgtcgttcaccctgaacggtacggcctgcgcgatcggctgagcgtgacgcggaggtacggcgcggcggcgctcgccgcgtcgtaccccctgatcgtttctggtcaggaatcgaaggagaaaccgaagaggttggcggtcttgagaatcaggccgtcacggccgccgttacggtcggcgcgggcgatcgcccgccggatgacctgcaccgcggggtacgcgatgggttccggcgggatcggcatcggtcgcctggtcgccatccgcagccgggtccgcggcgtgtcggccccggcgagaaggtccagcatgacggcgccggcgaagcgggtcgcggccacgcccaacccggtgaagccgctggcgtaggccaccttgccgcccatcgcgaggccctggaacgcggccagccgggtcgacatgtcgatcatgccgccccaggcgtgggtgaacctgatctcgccgagctgcgggaaggtgcgcaggaagtggtcggcgagccgggcgaacgtttccggtcgttggtcgaactccggccggatgtcgccgccgcggtggtagaccgcgtcataaccgccccagaggatccggttgtcggcgctcttgcggtagtagtggaactgccgcgagcagtcgccgatcccgaaccggccgtgccagccgatctcgtccagttgcgccggggtgagcggctcggtcatcagcacgtagtcgtagatcgggatggtcagcatccggttgcgccggagcagcgacgggaagccgttggtggccagcaccacctggcgggcgcgcacgacgcccatccgggtggtggcgcggaccgtgccgccccgatcggtgagtctggtcaccggcgtgtgctcgtagatgcgtacgcccagtctgcggcaggcgtccttgaggccccaggccagtttcgccgggtgcaccagggccgcgccggtctcctggaaggaaccggcccggaacagcggcgacttgacgatgccggccagctgctcccggtcgtagaagcgaccgggcgccgcccgcagttcctcgacctggtgccgttcggtggcgacggcgagtgagccgttctcctcccactcggcgtcgatgccgtgccgggtcagcgagtcgcggaagccggcgaagttctcctcggcgaggccttccagcaccgcgaggtcctcgccgaagtagcgctggccgttctcctggccgtgggtgaggctggcctcgacgaatccgccgttacggccgctggccgcccagccgatctcctcgccctcgaccaggacgacgtcgcgggccggatccgcctctttcgcctggagcgcggtccacaacccacagtaaccaccgccgatgatcagcaggtcggtgtcgatggtgccgatcagggcgggcagcgggacgggccgtccgggatcctcgagccagaacggggtccgggccgcgtcggcgagcgcggcgcgaatccgcttctcgtcggtccggatgtcaaggtcgtaggccggtgtgtccgcccgcatgctgatcctccctggtcagggccataggaaaccgcgtgcggtacgcttaggtcaatgcgttgacataaggagttccgaaatggcgaccacgcggggcagttccggcagggtccggcggcggcccacccgcagcggtgtgatcctcgaaccgtccatgatcatcgatgccgcgctgcgactgatcgaggcacccggtggcaacgcactcacggtccgtcgcctcggcgtcgagctcggcgccgacccgtcggccatctaccgctacttccgcgatctcgacgcgctgctgatcgccatcgccgaccggctgatcagcgagacgctcgccgggttcgagtccgggccggactggcgggccgcgctgcgcgagatgggccgcggcgtgcatgattcgatgctgcggcacccgcggctggccacactgcgcgccagccggttcaccgccggccccaacgagctgcgcgccgacgacatcggcatcggcctgctgctgcgtgccggcttccccgcgccggacgcggtgcgacatttccgggacttcatcgacgccgttctcgcattggcggcgatggatgccgcggaattggcgccggggcaggaggaagcggaccggcaggcactcgcccaggcatatgcgacgttctccccggaggaatatccgaatctcgccgcggtccgcgagcaccttccgcagatcgccgtctccgcgttccccggcgtgctcgacaagctggtcgacgcgatcgccgtgcagctgccggcatcgtaaacggctggcgtccggcgatcccgtcaggcgaggatgcggccatgaccgacgacggggacgcccgggcgctgatcctggtcgaagggatcagcgaccggatcgcgctgcgcaccacggccgccgcccggggccgcgacctcgacgccgaccgggtgcggatcgagccgatcggcggagcccacgccatcggccgctacctgcgcgacctcggtccggcggccgcccggctccgggtcgtcggcctgtgcgatcggcaggagcagtggacgttccgggcccacctgcccgccgaccgttacttcgtttgcgaccgcgacctcgaggaggagctgatccgcgcggtcggcgtcgcgtgcgtcgaggaactcttcgccgccgaacgcgacctggaccgcttccacctgttccgcagccagcccgcctggcggggccgcccgatcgaggcgcagatgcaccgcttcgtccgcagctcctcgcgccgcaacctccgctacgcccacctgctcgccgcggccgccgcgcggcgtgacacccggcccggcccgctggcggcgctgctcgacgcagtctgagccccggcttctcgatcgacctcaccgtccgggttccggaagtcggccgccatgtcgtggaggcggcgaccgggttcgcgagtggacccgcggatggcgcagcccatcatggccactgggcttcgggcgtgttctctcgcgaagcgatgtcgcgatggtgaagctcctgcaactcccgctccggcacctcctccagggcgatcagccggttgtcggcggccggcacggcgcgcagcaattcgtcgagcttgcgctgcagtgccacggcttgccgagcctgcgtgtgctgaacggtgaacaccatggtcagggtgatcagcgagctggtcacatacagggcgttctcccaccagccggggaagctgatcaccacaccgatgatcagccaggccacgaccagtccggcgaccgcgagaccagccagcgagtgggcggacagttcgccgagccgatggagcagccggctgctgagggcgcgctgccgccagtatcgccgccgggtccggtgtgccagagcgacggctcgctgatgatcgtccacaccgcttccggagggttcgagggtcggcttcaccacctgatcccgccctgctgaccgatggacctgcgatggggagaccgacggctgcgggatctgggcaccgaagccctattccgctgttgaccagcgaccaaacgtcggcggatcgtcggagaccgccgacccgaggccaccccgggccctatcgttgcaaccactcgacgaatccgggggcggccaccgagcgcagcaccgagtcgtaggcggccaggtcgtcgtcggtgagcacgtcacgccactgcccgctccggcctgaccggaagaacgccgtctcgctggtgaacaggccgagacgctcgtccgggacgagccgtgcggcattgccccgcatggcgtcgaagccggccgcccccaccagcgccggccacgatctctccggcacgtcgagagccaggtgtccggccagcgcccgcatctgcccgggcaggtcggcgctcagctcggcgtagtgcagcagcaccaccgacgggtcggcgcggcactcccaggcctggccgaggtggtgaaccatggtgcgcagcgtgtccatgccgacggtcggcggccgctcgtcgtgcatccactgcaggatccgctcccgccgggacgccggccgccgaggcgccgcgccgccacccagcagccgctcgaagaccgtgccgtccagattggcgcggtggtggtcgatcgacaccccgacgtcccgcggatcccggccgatcaccagatacgtcacgcccggccaccgcggcagcccgtccagcggcgtgtgcgtcttgatgaaccggcggtgccgttgggccgcgagcgtcgccgttacgtccccgatcggccgcagccggatgtccagccacggcgacagcgtggtcagcggcgccggcaacgcgggctcctgcaggatcagcagtgcgcagatcatctgcagccaggtggtcccgcacttcgacggcgcgctgatgacgatgtccccggtccgcggctcgaatcgctcccaccgcgtgctgtcgttcaacccggcccgatagaccggcagcgtggtccccatcgtgagaccctaccgaaggcagtctttcgggaagaacctgatcagcgggccgcgcccggctgccgtcgacccgcaggcgcggccgggtcaggcagtggtcacccttgccgcgcgcggcccgccggcgcggcacccgcctgttcgcctcgggcttccgcgtggagcaccggccgcccgccgatcgacggtccgccgccggcttccgcgccgctcgtcctgccgggaggatcggtggccgatgtcccgggccacctggccgcccgattgactctccccgtgcgggagggtgcaggctgtcgcggtggcagagttactgacggtcggggagttctcccggctgacccatctgacggtcaaggcgttgcggcactatcacgatgccggggtgctggagccggcgctggtcgacccgtcgaccggctatcggtactacacgccggagcaggtggaggtggcccagctggtccgccggctgcgcgaggtgcggatgccggtcgccggggtgcgtcaggtggtgtcggcacccgatctgccggcccgggagtcggtgatcgccgcccacctcgacgtcctgcgtcgggagctgaccgcgaccgccgcggcggtcggatcgttgcgggcgctgctggccggcggggacaccgctgagctgatcttccgggacaccgcggaacagcactgcctcatgatcgacggtgatgtcggccaggacgacctcaccccgtggtgtgccatggcctacccgcggttgtacgccgtcgcgggccgccacggtctcgtgccgcggggtccgtccggcgcgctgtacgccttcgcctggttccaggtcggcggccgcgtgacggccttcctcccggtagccgccctcccggcggcggacgacggagagcagcgtgccgggatcctcggcgagggggtgcggtgggggattctgccggctgggcggcatgcggtcgccgtgcacgccgggccctgtcacgacctggaccgcacctacgccgggctggggcgtcaggtgctggcgcaggggatcggggcgcccggtccggtccgggaacagtacctggtcacgtccgcggacaccgatgacccggatcagttgcggaccgaggtctgctggccggtcgtcgctgcggggtgacggtgctcatgtcgtacacaagtaatcgattttgaaggagttccctgatgccgctgtccatcgcgcagattgtcatcgactgtgccgacgcgcagaagctggccgctttctgggcggaagccctggaccggccggtcgacccgggcgccggcccggaattcgccaccatcggtcacggcgccgcctcgaccggcaacgcgccggcgctgatgttcatcgccgtcccggagcccaagcgcggcaagaaccggctgcacttcgacctcgccgcccgccaggtgccggactggcgcagcgaggtggaccggctgctcacactcggtgccacccgggtcgatgaacaccaggctttcggctggcactggatcaccatgcgcgacccggagggcaacgagttcgacctcggcgcgggcgccgccacgtcctgaccgccgaacccgaccacgcgtgcgacgggcccccgggagcggctgccgccgctgatcagccccgccgagcccgctctgcggacgcgtacggacaagggtgatggaacctttcgccgtgccgatgtctttcgaaggggtgagatcggttcggcaagggggttctgagcgtgacggaacggatcagggagttgctcgacgaggcggtcgccgagcttgagcccgggtatcgcgacccggtcgcgacggtggtccggcgcggccgggccgcccgccggcgcaccatgctggcggcgaccctggccgtgatgctgctggccggcggcctggtcgccggccggcagatgctggccggcccgctcacaccgaccgccgccggaaccgccgattcgcggccccgcctggtcgacggcaaggtgcgggccggcgcggtcgagattccggtcccggcagggtggcgggtggtcaccaacgatgcttcacagccctgcggtgacctgaccgagacgatcatgttgatcgtgcggaacaaccgcggctgccagtacgcgccgatggagatctcggtcgcggccggccgcaatcccggcggcactgtgctcttcaccgccgccgaaccgttctcctccggcgacctgatcaccacgccacgatccgtgacgctcgccggtggcgagccagggtggatgccgtcgtcgccggaggacgcggaactggcgcccggccgcgaggggtaccactactccgccgagctgctgctgccctggtccgacgtgttcatccagttccggacggacggcccgaccgcccggcggattctggagacgttccgcagcacgccccgcgagggcggcgcgctgaaggtgccgaccagggtcggctcggtcgacctgacgatgcccgattcctcgggcagactacggccggccggtcatggcatctcctccgacccgaagaccgtcaacgcggtcctcggactgctgcgcgaacagaccgcggtcgtgcgcgacggcgacgcgtgtgccggcactcagcagttgagcgcccgactgtcgctgatcgcaccgggcccgtccccgtccccgtcgccggacgcgatgtcgttcccggtcagctcgccgaagaccaccaccgtcgtgatcgcgctcggcacgaaatgccaggaggcggtgtcctcggacggcggccgggtgctgctcagcgacaccgccctggcccggttgcagggcctgatggggatcggtgcacggtgagcgatcgcaccgcgccacccggcttcggcgagttcgtctccgcccgctacccggccctggtccgctacggcgcgctgctcaccggcgaccgcggccatggcgaggacctgacccaggacgccctggtcaagacctaccgggcgtggcggcgcctgcatccgcagggtgacccggaggcgtacacccggcaggtgatggtccgagcggcctggcgctccggccgccgcctgtggcgcttcgagatcccggccgaggtgctgcccgaccggccggccgccggcgacgtggccgaccagctcggcaccgccgacctggttctggcggcgttgcgggaactgcccgccgggcagcgcgtggtactggtgctgcgctactgggccaacctgtccgagcaggagatcgccgcccagctgaactgctcgatcggcacggtcaagagccgggccagccgggccatcaccgccctgcgccgcgccgacggccccctggccggcgcgttcgccctggccgacgggccgcgccggtgaccccgccggcccgggtggccggcctggacggggtgcgcggcctactggcgctctacgtggtgatccaccactgctggctggtctgtttccctggctacccggccaacaccggcccgtggtggggcggctggctgatccacggccggctcgccgtggtcgcgttcatcgtcctctccggtttctccctggccctcgccccggccggccgcgggtggcgcctcggtggcctgaccgacttcgcccggcggcgggcccggcggatcctccccgcctactgggcggcgctgctggtcagtctggccgtggcaacactggccggcccactgccgatgatccatcgggccgacgggcggatcgctgtcgtctatgcgttgatgttgcaggacttcgtccccgcgcccgccccgaacggcgcgttctggtcgatcgccgtcgaggcggctctctacctggcgttcccgctgctgatcctggtccgctcccggttcggcgcgctggccaccctgggcgtgtccttcgtgccggtgctgatcgccggtccggccgcgacgaccggcttcacctgggagatggccccgttgttcaccttggggctgctcgccgccggagtcgccggccggccgccgcgcctgccctggtggaggctgaccgcattcgccgccactccggtgatcgccctgatcgcgtggcgtggaccggtctggaccgaacaccactacttctggatcgacctgttcgccgggcccgcggtggcgtcgctgctgatcgcggtgtcggcccgcccggcccggctgctcagcgcccggccgacccgcgggctgggcctcgcctcgtacagcctctacctgctccacgtgccggtggtcgcgctggtcagccaccagctcggccgctccttcccggtgctcgtggcggtcgctgtgcccacggcggtgctgatcgccgccctgttcgccatggtcttcgagagggcacccttccggagagcgggaaataccgaacagggtgaacgagcggaccctcaccacaacgctgcacgagggctggaaaccgactcccggatcatggtcgggcccggagcaggatccctgcgagggtgagcgcggcccagtagtggacgggtgctcatggccgaaccgtgccgttgttcgaaccggttgatgcagcgttcgccgatgttgcgctgtccataggagacggagtcgacagcaggtgaacgcggtcttctcccggcctgagcctcggcgcgcgacgggtctaccggctgacgatcacgtacgaggattccaggaacgaagcgtggaattctgtctctggatcaaggccgtcgggtacagcgcggagccggtcgagtatttcgacgaggtccaaggtggcttggaggtgcgcttcccgcttgtcgcatcgggtggcgtatccgcgccggttgaagccgcgttcgacctggtcgcgccgttggacggcgtccggatcgaacgcgggtcgacgcgacgctcgagcgtcgcgtcgaccggggcgtccccgtcgctgtcgccgtcgcgctagcggccgtacttgtcgaacgagacggtccagtcgccgagaccgttccagatcggcagttcccgcgggctgttcttgacgtcgacgatgtcgccgaccaggaagttctcgtagacccacttggcgtcgtcgacgctcaggttgatgcagccgtgcgagcggttggcctggccgagctggtggttccacggggcggcgtgcaggaactcgccggagtaggtgatccgggtgcagtactcgatggtctcggcggcgtagtagtacgggtttttcgggtcggagacgccgtagctggccgagctcatgtcgtgcttgcgctccttggagagcacgacgtgcgggccgccggcggtccagaagctgatcttctgaccgttggcgccggtggtggtgccgcccatgccgaggctgcacttcatgcggcgcacgaccttgccgtcgatgtacaccttggcgacgtgtgtccggttgtcgacgatggtgatcagctgacggccgatcttgaagttggccgacgcgttcttctcgccgtagacgcccttgccgaggttgaccccgagggcgttgacactgactttgacggtcgagccggccgtccagtatttcgccggccgccagtgcacggttttgtcgtcggcccagtagaacttgccctcgaccgacggcgaggtcttgatctcgatcgccttctcggcgagctccttgttgaccgccttgctgaacgccacgatcaccggctgcccggcgccgtaggtgtgccccgactgcagcgcgctcatcgcgttggcctggaaggtgacccggaccgtggcgtgcggcttgatcgtggagaacgaggacgacttctcggtcttggcgcccgtgctgtcggtggcggtcacggccaccttgtacgtctttccatacgccaggtgctcggtggagacccaggagccgtcgggcttgatctcgccgtcgaccttctccttgccggcggtgacggtgaccgcctccagcttgcccccggtgaccgcgacggtgatcggcttcaccggggagaccccggtggccccggcgtccggcgtgacggtgacctgcaccggcgcggcggccgcggcgggctgctcgttgttggccacgggctgcgtccagatcgtgcccccggacgtggtcgcgtcctttttcgaggagcaaccggcaaccgtggtggcggccgcggcaacaccgagtgaaccgatgatgaccttacgtcgctgaatcattggctctcacaatcgaggggggtccggcctgcgccatccgtggccgcacaaggatagacgcggctgcgaccggaaaagttgcctgccggatcgatctatttctgatgcggtggagggaccgggtcatcttgacagatcttgattcgattcgggaccccgcatcgagtgatataaaccagacattccaaagggagcgggatagtcgccccgctggcgaaacccggggtgtgtccgtcgttacatcagtgccgcggcgggaatcccgcagcagggacctccggccccggccgccgatcgaactgttcccgcccgctaccaatcgagccgattgagccatccgctccggatggtcgcgcctgctggacgacgccgggggcgatcgagcagtcccgcagcgaggcctccagccgccgggtcgcaccggtccgggaatcggccgggtccacggcagtgatcgtaccgcgcaaaaagcatgaaaagggcgggcccggaggcccgccctcagacgatcatcagcaggtgggctcaccggactgggccggcaggctcaccgcgttccaggcggccttgaccgcgttgaactgggtgcagctgcccgggtacaggttcttcgcggcctgcagcgtccacacccggtacttggcgtaggacgagctggaggtcttgagcagcatcgcgttgtacatgatcttgatggcggtctggatgcccaccccggtcaccgacgcgccgttgcaggtcgggctggccggctggccgttcccggcgctgccctgggcgagcaggtagaaccagtggttgccgggaccggccgcggcgtgcacctcctggctcggggtactgctggagtagcagttgctgtcgccggccagcgacgggttgtacatgtaccggatcgggccggagccgaccaggttgacctcttcgccgacctggtagtcggccgggtcgttggggttcgccgcgtacgcctcggtcgccgcgccgaaggtgtcggccacgaactcctgggtgccgcccttcgacaggctgcccggggtgtggtcgtcgatgccgtgacccagctcgtggccgacgacgtcgagcgacgcgatccacttgccggcggtgttcttgccgatctgcacctgggtgccgtcgtagtaggcgttctggtcgttcagcccgacccgcagcggccaggcgccgccggagccgtcctgcccgttgcgccccagccacgcggagagcatcgccttctgcttctgcgccacgtacagcgcgtccacacagccggtctccttgctggtgccgaccccgttgccccacacgttgtcggtgccgctgaacaccttgttcgtcgaggcgtcctggcagctcaggttggtcgtcgagggatccttgagggagtacgtcgacccggacagcgtggtgttcagcgagaccgagccgttgatccagccggtgccgctgccggtcgcctcggtgacgtgctcctcggtggagagcaccttgccggtctgcgcgtccacgtcgacggtcagccggctcgctccggtcgcgctgcgcccgttcaccgtggtctcccaggccagcgtcgccgcccggccgtcggccgtgacgacgatcagccgggtcggctcgacaccggacacgctcttgagcagctgccgggcggtggtcaccgcggagctctccgagattgccggtacggtcgtcagctcaccgatcgcgttgttctgcgccaccgaggtgtagcgcgtctggccggcgctgtcggtaacgaccaccaggtcgccacctttcaccgacagacccttgtacgtccggtcgtaggccgcgtaggtcagcccttgcgaccggatcacctgacggcggaggaagccgtcgtgggcgctggcgtgcagcgccgccggtcgggcggcgaccagggcgtcggcccgcgcgaccgggtccgcgccgggtgccttcgccgcggccggaccagccaccgcgaccagggcggacgccgccgcggtcccggccgccagggcgatgcccagggggattcgtgccatctcacgtactcctttcccgcccatgggggtagtgggcgggctagacccggtccggcggagtagccggtaccgggtgtgccggaagtgacgttatctatctgcgtctattctcgaaatagggaaaaccctcgcactccaccgaagtcgggtcccggtgacctccgcgagcgcatctggcggacctgctgagcggccgcgaggatcacggcggccggcggcctgtctcgtacggcgtcgaccgatgcccggaggccggttgacgcaccgcttcggccggtcgtgggcggggtggtctgccggggtgcgacaggatgactgggtgtgtgcgggggctggtcccggtttgtatgctgctgtcctcatggatgccgaccgcacgccccgcgaacgtctggttgccgcggcccgctcgctggcggccgagcgtggctgggacaaggtgcggatggccgatgtggcgcgggccgcggggatgagccggcagacggtctacaacgagttcggtgatcgcgccggtgtggcgcaggcgctcgccgtgtgggagatcgagcagttcaccggcgcggtccgggagcggctgttcgcggcgggtgcggacgtgcggggcgccgcgtacgccgcgatcctgcacaccctgcgggaggccgccggcaacccgctgatccgctccatcctggacagctccgccgacggcctgttcccgtatctgaccacccgctccgacctggtgctcgcggcggcggccacggtgatccgggagtgggccgacgcgtgcgtgccgggcgtggacgcggcgctggccgccgagtcgatcgtgcggctcaccgtcagccacatcgtgctgccgggggagtcgccggaggcgtcggcggccgcgctggccgaggtgttcgtgcggctactgcgctgaccggccggccgcgttggccagggtggcgtcgccgcggtagtggtcgaggacccggtggtccatcacccgccgccacaacggggggacgagcgccaggagcagcatcgtggcgtaccccgcgggaagttgcggtgagacctcgaaggtacgcagcgtctggtagcgccgctgcgggttggcgtggtggtcgctgtggcgctgcaactggaacaggaagatgttggtggtgagccggtcgctgttccagctgtgccgcgggtcgaccttctcgtagcggccggtcggggtgcgttgccgcagcagcccgtagtgctccaggtagttgaccgcctccaggacggagaagccgaccaccgcctgcagcaccaggaagaccaggatggcggggccgaagacggcggtcaacgcggcgaacaggacgacggtcatcagccacgcgttgaggatgtcgttgtgcagccgccacgggctgcggccgcggaggcggtgccggctggtctccaggtgccaggcggagcggaggctgccgagcacggtccgcggccagaagcgccagaacgactcgccgagccgggagctggccgggtcttccggggtggcgacgcggacgtgatgaccccggttgtgttcgacgaagaagtggccgtagccggtgggcgccagcgcgatcttggaaagccagcgttcgacggtctcccgcttgtgaccgagctcgtgggcggtgttgatggcgatgccgttgaccaggccggcggtcagcaccaggccgagcccgggctgccgggtccaggcggcgcaggtgatcaccagtgcggcgtactgcgcgggcaggaacaggaaggtgatccagcggtagtacggcgacgcctgcagggcgggcaccgcctcctcgggcgggttggcgcggtcgtcgccgaccagcaggtcgatgaccgggatgacgccgaggatgaagaccggggtgagccaccacgcccacccggatccggtggcgcgggcgagcagcagggcggcgaagggcagggcgggaaccacgagggcgagtggccacagcggacgtttgacgtcacgccacgacccggctacagcagcggtcatgaatagatgttttacaaaataggccttcgtgtcaagtggccggtttccccgaccggctgacactcggacgggtgtcgttgcgtgtcgggcgcgcacatcgccgcaggtcactgacggtgactggcgtcttcccctcttcgtccggttttccgcggccacacccggcggccagcctgttcccggtcctgacggagaacccgagagaagacgatgtccacctatcaccagagcttcaccacttccggcaacgcccgggtcggcacccagatcggccatctcagcggcgacctgcaccagggcgcctcggccggcctccccggggagatcgaccgactgcgcctgctgctggaccgtgcccacgagcgcggcgacctggacacggacaccctggcggccgccgggcaggacctggaggcggcccgcgcggcggtcggcgagtcccggcgcggacgtgccgtggtcgcgctgcgccggctgaacggtctggtcggcgacgtggccggactggccgccccggtggccgcgatcctggccgcggtcaacgggagtggcgcgtgaccgactgggacgaggacgtggcgcagaccttcgtcaaccaggacaacgcctatgtggacacccagatcggggtgctgcacggcgatgcccacttctaccacgtgaccggtgacgccggcccggaggagcagttccgggtggcggtcaactacctcgacgccgggctggccggggaggcccgccgccggatccgggaagcggtgatgaccggcgggctgagctcggccgaggtcgcctaccggtgggcgctcgccgtgctcagcggccgccggctgaccgacctgtcggacgaggatctggccgcgctggaacacgcgttcgcgatggccggccagtatcccagcgggcgctggtggcggtcggtcgcggtgatccagggcttcgtcgacgccctgctggcgctcgggccggacggccagcccaacccggtggcgtgcgccgaggcgctgcgcgggcacgccgccctgccgcccgaggaccggctggagatcgagagtcatctcggccagttcctcgcgcacatcctgcgcgacgacgccgaccagcgcaccgacgagcgggtccgggcggcgcggctggccggggaccgccgggaccgggtgcccaagttcttcgagccggacccggcgccgccggtgcgcaaggtgccgctgcagaccccgccgggcagcgcctggcggccggtcgccggcggcgccgcgatcgccgcgctggccctctggacgttgctcgccgagctgggcgaggtgagcatcctggccacgctggcggtgaccgcgctgctcggcgcgggcggctggttcgccggccggcagctgctcgaacgggcctacctggccagccggcgggcggccaaggaggccgaactgacccgcggggagcgcgccccgatcgaacgaccgggcaaccaggcgccccaggagggtttcgcggacgcggtcagcggcctgatcgatgccgcgttcgcccggcggcagcccgccgatcacagccgggacgctttctggcagcagacctggggattgcgggccgcgctctacggcgacctggtcgacctgtacgcacacgccggggtgccggcggccacactcgcctggctggtcaacttccacgccggggagatcgcccggcgctggcgggccggtggcctcgacgaattccgccgggaccggccggccgccccgctggcctccccggagttcgccggtgggctggcggcgctcggcggggccgcggtgatcgccgtgctgaccctgctgaacagccacttcttcggcatcgtggtgaccgccggcctgctgtacctggccacccgggtgggccgcggcggcgccatggtgctgtacggcgagcggcggcggatcaccctggacaccgccgagtacgcccagcgcttcgacgccgagaccgccgcacaccagcgccgggtcgcccacctcgccgaccggcccaccgacgtggagatgggccggtggctggccctcgacctcgcctacttcacccgggcggtcctgctggactcccggctcaccggccgcgacgtggtcacccaactggtgctcaccgaggcggccgcgggcagcgtgcgggcccggatcctgggtggaccgttccggcattcggcgtacacggtgctgctgttcctgctcaccgagggcggggtgcgccgggtgcaggcgcggctggaattcgcgtccgggaagttcgtcggcgagcggcgggacaacttccggtacgaggcgatcgtctccgcccacgtccgcgaggtcggggtccgcttcgacgacggccggccccgggtgctgaccgacgacgagtcgtatgcgttggcccgcaccgacaaggtggtccgccgggaggccctgctgctgaacctgatcgacgggcagaagatcccggtgctggtggaccacttcgacccggcgacggtcgacaccggccgcgaagatccggaccagctggcccggctcgccaaggacagctccggcgtctccagcgcggtccacgtcctggaggcgatcgccgtcgagggccgggagtggatctcgctggagcgcacccggatgtaccggcgactaccccggcgccgtacggtgccgggccagccgcagggccgggaactgcacgccccaccggtcaggtggtgaccggcgcccgcccgccgcggggcgggcgggcgccggacgcggtcagttccggtagcggtagagaatccggcccctggtcaggtcatacgggctgatctcgaccagcacccggtcgtacggaaggatcttgatgtagttcttcctgatctttccgctgatgtgggcgagcaccacgtgcccgttcggcagctccacccggaaggtggcgttgcgcaggcactcgaccaccaggccctcctgctggatgccgcggctcgcgtcaggcatgccgccccctcaacgccgcccgcggctcgctgccggtgagtggccccctcaggaccagctcgaggttgctgccggcccggcggccgccgaacccgtcgaacagcgcgaccgcagcggtgttggccgagttgacctcagccgatgccgtggcgacgccgcatcggtgcgcgtcggcgagcacctcggccagcatcgcccgcccgatcccccggccgcggtgcgaggaacggaccgcgatcaggccgatgtgcgggcgccggggcatcgggccgagacgggtcagccccacactctcgccgtccatggacgcgaccaggtagcgggccggttccagcggccgggtcagcacctcggccggcatgttctgccacccgatgcccgcctcgacctcggcccttaccacggcgtacaaccgctgcaaggaggttgcctcggcgggcccgacggtcactcccggcggcggcgtcacccgaccgccactggtgggtacgacatattcccactcccgccggcgcgggccgaaaccgaaccgttcccaggcggtgagcagctcgagatcggcctcgtccaccaccgtgtagagcggccgcggcagctccgcgagcatcgtctcggccagccgccggaacacgcccgcctgccaggcgtcgacgctgacgaacgcgcgcccgtcgggccgtcgcgacacctggccccggccggccacctcatcgtcgacgagagcgtgccaatgccgctccgacacccggatcacgtcagaagtatttgtttccatggcatgccgcctttcctggagtgccagacgtgggcgctccggggcggctgcctagatcagccctgagccgtgcggacgagggggagcacccacatcgaagtaacgttcacggggtctcacctcctcaggtcgttccacggctgcccgggacgttatcggttgcggtgccacgctgtccatccattaatccgccgccgacatctgccgctcggcccggctccggcaccccgccccggcgcgggaggatggcgaccatggagtcgcaccacgaccacggccacgggcaccaccacaccccggagcccgcctggcccgcccccgccgagtggtccgcgcccagccccgcctccgcgcccgactggccctcgccgtccccttcgaccgattgccccgcggcggacgtgtctgcgtcgcccgcgtcgaccgattcccccgcggcggaccggtctgcgtcgcccgcgtcggccgattcccccgcggcggaccggtctgcgccgcctgcgtcggccgaatcttccgcggcggacggatccgctccgggcccgatggaatgggtgatcgcaccgcccttcaccgacccggccacgccgctgaccgacaccggctcgccggcctggaacaaccagccggccccggccccgtggccggaatacacccccgccccatggtcggatgacgcccccgccggcggtgccgctcccgccacctccgggcaccacgctgtgcccgccgaatggcgaaacaccggcaccgtcacccccgcggccggaactcgccgcgcgaccctcgccctcctgctggccgccgccgccgtgcccttgtccctctgcgccttcggcctcccggcgggggccgccatcctcctcggcgccctgcacctgcgccacaccaccagcggcgccccgggccgccgccgcgccatcaccgccatctgcctgagcgcggtgctgctcctcccgtcgatcgtcctgagtatcgggttctggtccgccacctctgcgtgaccccggcgcccaccgggacgcgctggtcgacggtgacggcgtcggtggtggcggcggaggcgtaggtctgtccggccagagggtcggccgcggccggccccctggcgaggtcccgctcgatctcgggaactatcgacccatgccggcgccgaggctgttgagggccttctggaccatggcctgggcattggcgttcaggtcggcgttggtgccgttcacgatccaggacgaaccggagaagatcgccacggttacgccgttgtcgacgccgccgctggtgccgctgctggggatgccgagcagcgaggccgccttcaccgacgcctcgccgagctcgcgggagtcgttgtccgaggtggtctggtcgttcgcggtctgcgtgtcaccgaagatggcgccgatgaccttgccttggtagaaggccagcgcgaactgccgcccggagatgccgtgctcttcgtagaagaagtgcgggcagggcgagacgcggtcccagcagtcgtcacccaggacgtagaacggcacgtggtgagcgcccagggactgaccgttgctgtcccggaaggtggtctcgccctggtggtcggggtcgggatcggggtcgctgccgtccgtgtcgatggccatgccggaggtgtaggcgtacacgcccgacgccacctggtagacgttgacgttccgggcccgcgtcatggtgttgatgtgcggcttggagttgacctgcctggcagccgtcatgttcctctggatgccggacagtacctgggccggggtgtacgggcccggcccggtgggtggcgtcgtcggaccggtcgtcgggccggtggtgggtccgcttcctcctcccgacagggtccatttctgccaggcgttggtgttgacgtcccagatttgcagctgggtgccgttggtcgtgctacccgccgggacgtccagggcccggcccgaagccgcgctgatgatgtggccgtccggccgcacggtccacttctggttggtctgccggttacagtcccagagctggattttcgttccgttggccgtatattgccctgtcacgtccagacacttgccgagagcacgaatcgtgccgtcggtacccaccgtccacgactgcgcgggaccaccgttgcaatcgttgatctgcacggccgtcccattggtcgtgcttgccccggccacctccacgcatttgccgctgctggacttgatggagcccgtgccgccggtgggtggcgggcttgtcggtggagtggtgccgccatccgtggcgatggtgaaatcaccctggttgagcacacgagcgttgctgaaggtcgaccggatggtcgagttgcacccgcactgggcgatgtattccgaccagatcatgaaataggtccagttcggctgactcgccagcgttgccgcgctcggcgtgttgcccagctccgccaaggcgatcggtttaacaccatgcgcgatgttcactatcgccgagtaccaggccgaagtggggaagttgttgttccacgggtcgagcgtgaccacgtcgacgtaattgtcacccgggtagtaggctgctgccccgctcgcgctgccggtgtccttgacgttccacacccaggcgatgttcgtcagccccttggacaagaagtagtcgtgcgtgagctggtacagcttcgcgctaccaccggacccggaacggccaccccaccaggcccagccgtcgttcatctcatgcaggggacggaacaacacgggcacgccggcgtccttcaattgctggaaaaacggaaccagctggtccatcttcgccttgtacgcgttgttcaacgacgaaccgtcggtaagaagcgacgaccactcggcatcgctcagctcgctgcccacaataggattatcgccagtgtcgaactcacaggtggcgacatcgggacggcactggtgccaggtcagcgcaacgagtgaacccgcggaccactgcgccttggcctggttgatcatcttctgccggttcgggatgtcgccggcggaaaaccccagctcactgccccacaggcccggcgttttcccggtgatggactgcatctcggccgtgtactccgtcggattattcaaccccttgttgtgcaccccgctgacaatcttgccgccggtgatcgatgtgaggaaggcgaccacattggccgggctggtcgcggcgaaggcggacgcgttggatgcgggggccatgagaccggcggccacggccacacccaggacaccgagtccggcgacgatcgatctccgggaagaatttcttcgtgtcatctgaaacctctcacacgacgaatcggggataattcagcgctgcagtgacagccttggtgatggctgcctccattgagcgcggtgcgctgtgagggacagttggaatcacattcgtatgtgtcggaaacgacgccgctggtaccggagcctcgcagcacttccagtgccgaaattgcacatgctcgacgcattttgccggcgaatgtcactgacccgtgcacagcgtggaaacggggatggcgggcacggaatcagtccacgtccgcacattcgacggccggcccggcggcgcctggctggtgcaataggccagcgctcaaccgcgaatattcgcgcgcgcatccaagtgcggttctacttcggtgacggcgccgacgtgcataccgtcaccccggccgtgcccggagaagctgaagaacctgctcaaggtgccgttcggctcggcccgcacctcggcgcgatcagggcccgggctgccggcatgtgccgtgcctgttcggccgaggaccggcagcggccggtaggccggctaccacgtgaacggagatgcccatcgcagggccatggaggggacacagcgctcctcgagggggttgggtggcgcggtgtttcacaggtcgaagggagagcaccacgccgccgagggagtggtgacaccatatattaattaagttgacttatcaatgccggtagatgtgtcagagtgaagttaaaaattgaagctcttcaggtgtccacaccagccgttggtcgtacctggccgccgcgctacccggcgatcaactcagctacgtcctcgcggcagcccgctcacaccgggcgccgaccggtcccggcgtccagcgggcgggtgggtccggtcataggcgcggtcggcgtccagccattcggcgtcgttccacggcacgggcatggcgccaacgggctcgaagctcaaccgtggatcgtccgactgcaccgggcagatgatcctgcgtcagccgccgctcgacggctcggattgggcgctccgtcgcgggccggggcgctgaagttcaggcccgtggccggcgggtcggggcggccgcgctcgaccggttcgggcgtctcgtgccgaccggtggaagccctcggccggcaggaacgtgcggacagcaagccccggtgggtgtacgaagtcgccccccgacgacgtgcctacccgttcccgattgtccgaggtcgatcactgttcgccggagaatcgctcccaggcggactgccgggtgatgcccagggcggcgcctatccgcgcccaggtgactttccggttgcgcaggatcgtgaccagccgctggatgctcgcctcggactgggcgccgaccgccacgatgcggggaagcaggtcgaggatttccgcgtcggtcatcccgttctcccgagcggccatgcgggcagccgatgcgagcgggtcgtcgtcgccggacccgagaatgtcgttgcacaggtcgacgcagatgttgcagatgtacacgcccggcccggcgatgatcttctcgacttcggagctcggctgggcgcagaaggagcagcgcagctcgacgctcaccgggtccgcagcggtgtcgcccgacatgtggtctcccgacggtagaggaatgtcaggctaatcctgacaaccccgccgtgtccaggggtgaccgcgcccgccgagccgagttgccggtcagttaccccagggtcacgccgccagggtagtggccagcacccagcgcccgcggccctggcgtttcgcctcgtacatggcggcgtcggcggcgcgcagcgcgtcccgctcgtgggcctgctcgccggcgccgtaggcggcgatgccgatactggcgccgacgtccagctggctgccctggaacgggatgggccgggccacgtcggcgaccacccgctcggcgagccggatggcgtccggcgccggcaggtcggggcagaacagcacgaactcgtcgccgccgaggcggaccaccaggtcggtgccgcggacggcggcggacaggcggttggcgacggtggtcagcaccaggtcgccggcctcgtggccgtagcggtcgttgacctgcttgaagccgtccaggtccaggtagagcacggcgacaccggtggggcggccgcggtccatctcgtcagtgagcatggcgcggttcgccaggccggtgagcgggtcgtggtgcgcctggtgggagagctgcgcctgggcccgctcctgctcgcgcacggccagggtgaaccgggtcagcacgaagatcgtgctggcggcggtggcgagcagggtggccaccgcgttcttggccaggccgtcctggacggcggtgaggacgggggcggtcaggaacgcgacgccgaggaacaggacgcgggacgggtgcagcacccggacctgggcgctggagcgggtcagctcgtcgcgcttcgggtgcaggcaggcggcggtcagcagggcgttgcccagcatgatcaggctgccggcgcgggccaccagcccgtccgacaggaaatggaacccgatgttggtgatgagatcgatcgacaggtagagggcgaccgcgccgaacagcaggcgggtcggcgcctggcgcgtgcccggggacagggcgatgaacagcagcgcggcgagcaccacgacgtcggcgaccgggtagagcgccgggatgatcgacgcccccgtggagtagccctgccgcagcgacggctcgatcaggaactgccagctgaccagggcggccgccgcggtcagggtgagcgcgtcgaggaccgcgccgcgcagccggccgggggcccggcggcgggccatcagtaccagcgccacggtgagcaccgcgtacccgccgagccagcagacgtcggacaggccgaccggcgggaccttcgccaggtagtagtaggccagctcggtcgcgtcgccggcgaaccagagggtctgcgtgacggcgaccagcagccacggccggcgctgcggcccggccggcacccggcgcatcgccagccaggcggcactggtcagcgcgccgtacaggaggacgtagaagacgttcccgaaggtggagttgtaggtcaccgctgcgagcgcgacggcaaccgtggtgcccccgagaaatccccaaaccctgcgtgctgccatgtcgtgggtaatcggcaggggcgccgccgtgctgtgcagaacgcggcatgacgcgggccacaccggcccgggaggtcagtgtcggtagaggcgcagcagtccgcgggcggcccagacggcgcgggcgcccaccatggccaccacgatcagcaccgcggggaggttgtccagcggatgcgagccggacggggcccgcacctgcgccgggtcgagggcgccggtggcgaacccggcgatcacgccgacgcagaggaccaggttgaccaggtagccgcgccaggtccagcgggacggcggcgggccggtgaaggcgccggccggcggcgccggcgcggtgatcgtgggcagccgcagctgaggctgcggcacggccgccgggtcgcggacggccatcgcggcccgcagcccggccgggacacgaccgtcgagagtcgggatcgcggcggcgaggcggtggaacatcgtcggttccaggtggaccgtgacgccgtcgtcgccgatcagccggcgggcgccgtccggccaggccagcacggcggcgcaggcgtcgaaccgcacggtagcggcggtctcgcccagtaccatgctggcgccttcggcgccgatgatcacgcgggtccgggccgggtcggcgagcgacgggaagacgtcgccgtcgatcggggcggtggaggcgaccggggccggagtccagccgggcggtccggtgtccgggcggcccggcttctgcagcagaccggccgcgaacgccgcgcgcgccacccgggtcacgtccgcccgggtgaccgcacgggtctccgacagcagctcgttcggctcggccggcggacgccccagcaacaggtcgatcgcctgcgaccgcgccccggcgccctgcccggcggcctgcgtcagcccgtcggcgcacagggtgacgaccgtggcgagctccgcctcgtcgatgtcgccgtgccgcagccggtccagcacgccgagcaggccggccagcacggcgtcctgcttctccgggaggccgtcggcgagcgcggtgatcagcgcggtgccgtcggcgcgcggcgcgtagccggccgtcgcggtgtaggacagcccgccgtccacgcgtagcgtgcgatgcagcgcgcgggccagcagctgggtgaagacgacggcggcggtctcgcgcggcaccacggcgtcccacacgattacgccgtccggcccggggaaatacccgggagtggccggcagggtcggtgtggccggcgccggccggcggtccccggcgggcaggtcgacgcccagatcggcgggcaggtgcgggccgctcacccacagcgccgcattgccgcgtacaaaatagtcgttcgtccagattttaagatcttcggcctgaaggccgtccagaccgaaccgggggtacgccgtgagcccatagccgtgggcgccgtgccgccagatcggcatcgcggcggccgccccgtcgtggcgggcggcgtactcggcgtgcaccaggtcccgcgccaccgccagccggtcggccggcagctcgcgcagtgcggcgcagaccccggccaggaaggcgcggacctgctcggcggacccctcggtgtggaactcggtgaggtccggcgcggtcgcatcatcctgatctgcatcggtcacagcgtgccggaccaggtgctcgatcagccgggtgacgccgcgccgggcgagcggctcgtcgacctccccgacccggaagatcaggccggcccgcagcggaccggccgacgcgacgaacacgccgggcacgccgccggtctcgaactggatgctcatgcgacttctcccggctatctcgtgacgtagcggcggacgacgccgaccgccggcgcggccgcgaccagcagcaggtcggcgatcccgggcagcccgccggagaggccgaaggcacgcatccgggcctgtcggaacgcggccgtgacctcggccgactgggtcgaccagggatactccgacgcgtacgggccgagcatggtgaacatccgccgcgcgttcgcccggtcgccgaccttgctgaacgccagcgcgaacgagttgaccacctggacccagccgacggtgcgggcgaacgcggggtggcacaccgaacgcccggcggcctcctcgatgtccgcccgcagcccccggaagtcggccttctccaggtagtagtcgacgagcaggaccgcgttgtgggcgccctcgggggcggcgcgcatggcggcgcggacgaacgcctcggcctccggccaggagccgctccacttggggcacagctgctgcaacagctgcgactgggccggcaggtggtgcggatcgaaagcggacaggcacgcgtaccggtagcgggcgtggtccagccccatctccaggccgcggacggtgagcaggctcgccgtccacagcgcgaggtcgtgcggcgtgcgggtcagcgcggcgtgcagcacgcgctccgcctccgccaggtaccggtggaacacccggaactggcgggccgtcacggtccgggcccggccgccgccgcggacgttccagccctgctcgatcagctggaaggcgcgaaccgccgacgcggtcggatccgccgggtccgccggcaccggctgtttcgcctgggccgcgtagaggcgcaggagccgggtgcgcgcctgcgggtcggcggcgtcggcggcccggaaatcgctgtcgcggagcagggcccgggcctccggatagggcgcggagggggagaggcggacggcgaggctgtcgagcacgagcgcagagcataggtgatcaccgcggagggtgtcagtcccggtcggccggcccatagagtggggcgatgtcaaaggtgagggtgcacaatctcgcggtttcgctggacggtttcgccaccggtgaggggcagaccctggaggcgccgttcgggcatgccggtgggcggctcatgcagtggttcttcccgacccgcgcgttccagtcgatgaacgggcaggacggcggcagcgagggcgtcgacaacgcgttcgcggccgcgtgggggccggggatcggcgccgagatcatgggccgcaacaagttcgggccgcaacgcggcgcctgggagaacgaggagtggcagggctggtggggcgacaacccgccgttccacaccccggtcttcgtgctcacccaccacccgcggccgacgctcaagctggagggcggcaacgtcttccacttcgtggacgcgtcgccggccgaggtgctcgcgcaggcccgggaggcggccggtggcctggacgtccgcatcggcggcgggccgaccacggtccgtcagttcctggaggccgacctgatcgaccatctgcacgtcgccctggtgccgatcatcctcggccggggagtacgcctgtgggacggcctggagagcctggaggaccggttcaccgtcgagtccgttgcctccccgagcggcgtcacccacctgaccttcacccggcgcccggcgtagccgtgggccggcggcgccgggcgctcgcggtccgcggcgttccggcgctgccccacgtccgggatcgccgccggcgcccggtgccggacgccggcggcgatccgggtcagagggtcagggccgcggtgacgatgcggcggcccgccggcgtttcacaggtcagcgtgaaacggtcgcggggccgcggagcgatgcggaaacagccgtcctcgtcgaccgggacggcggtggtggtgccgtccgccaggcgcagcgtgaggctggccggttcggccgggacgagctgaccgagcagggcggccggggcgacgcccagctcgatggtgaggtcgggcgcctcgaagctgagcgtgcgcaggtcggcctcctcggcgcgcaggccggccagctcgggcgggcgggtggccgagtcgtggacgagttcggctagttcggcgtcgacggtgcgccaggtgaagacggcgcgggcggcctcgaagacctccgtcggggtgcggtccggtgcggccacggctcggctcagggcgtgcaggagctggtcatcgtcgtaccaccaggtgtcggtcatttcttctcctcgttgccttcggcgtcggtgagcagggcgcgcagggccgggttgcggcgcagccggtccaggcagcgggagcgggtcgggccgatcgcgccgcacggcatgctcagccgggtgctgatctcggcgtacgggacgggctcgtcgcgcatcagcatgccgagcaggctgcggcagtgctccggcagttcggcgaaggcggcgcgcagggcggcgtcgcgttccgcggcgatcaggtcccggtcgaccgggccgtcgtcgtcggcgggggtgcgggccagccgggactccacatcctccgggtgttcgcgctgccggcagtggtacagccgggtgcattcgcgggccgtcgtggtggtcagccagccgggcagggcctgcggctcgcgcagccgggacaggttctccaccaggcgcagccacaccgtctggctcacgtcggcggcgtcggcctcggtcagccgccagcgccggcaggtggcgtagaccagggaggcgtaccgcgccaccagggcgttccaggccgcttcgtcgccggcggccgcggccgtgacgagcgagaccaggtcggccggttccggcggcaggcccgcgcgcgggcggtcgacggcggtcatgccgaccacttggggatcatcgtcgcggtggtgccggccgcggtgtcctgcagcagccggtgcagcgccgccggggcgtccgtctcgccgggccggatccgggcggccaccaggccggagacccaggccgcggcgaacgacgtgccgctccaggccgccagccccggatagcggccggtcgtgccgggggtgtccgggtcgaccaccgacaccgcgtcgccgaagtagttgctgaccacgttcacacccggcgccagcaggtccacccacggtgcgtccgggctgaacgtcgccggcatgccctgcggggtgagcgcgccgaccgccaccacctcgtcgtacgcggcgggccacatcgggcgccggccgtcctgctcgttctcgccgtggttgccggcggcggcgaccaccacggtccgcgggccgagcagccgcagcgccgtggtgaccgcgagggcgggctggtcgtcgccggtgaagaagccggccgacacgttgatcacgtccaccccgcggccggcgagggcgaccaggtcgttggcgaactgccaggtggtgccgcgggcgtggtcgtccagggtggggtggacgaccacggcggcaccgggcgcgctgcgcagcacgatgccggtgacgaacagggcgtgcccggcggtgaaggcgacaccgtccgggccgggcgggggcagcagcgcggccggcggggcgaggtaggcgccggccagcgcgccgtcgccccacagccgggtgtcgcagaccgccacggtggcgccgcgcccgcggtcgccgtcgagccgggccaggccgtcgtgcagagtgcggcggccccgggggagccctcgacctcgggcaggacgtcggcgtcggcgggcagcgctcggccggaccaaccgccggtcaggacctccgcctgggtcggggtgcccggcaggccgcgaccgccgccgctgatcacgttggtgctgccgaccatctcgacctcgcggttcttgccgagcaccggcgtccagccgtggtactcccggcggaaataggcccgcaggtcggccagcagcgcgtcgagtggcgagtccgcgccgtcggccgcggcggccggcccgtcgcgcggtccggccggctcgcccagttcgaccagggccaggccgagcgccgggctgcgctgcggctcccggaccggcgtccggccgagggtgccgagtcggtcgagcaccaggctcagatgtggcagagccacgatcagttcattgacgcggtgcgttgcggtcgtcgtgcccatcgttctccccgtgcgtgcgttgcgtccgggaaacccacccggcttctagggaaaagaacgactagcagtggatttgatacaaatgtcgctgacagtttcgtggcggtgcgccgagcggggagtacgacatggggcgtgacccggtcgctgagcggctctgcgacgaggcgctgtcctccgtcgacgcgcagccccggcgggcgtggggactcgccgagcgggccctgcggaccgctcagcgcgccggcgatccggagtccgcggcggtggccgaacgggcccgcgggctggccgccctgcacctggccgacctggacaccgcactgcgctgcgaacggggcgcggtccggctggccgagcgggccggcaacccgacgctcgccgccgaggcccgaatgaccctggcgttcgtgctgggccgccggggccggaccggcgacgccctcgccgtgatcgaccaggcccgcgccgacctgcacggggtgcagcgactgcgggccaccgcccagcgcggcgcgatcctgcagcacgccggccggctcggcgaggccctggacgcgtaccgggagacgctgccccggctgcgcgcggccggcgacgcggtgtggacctggcgggtgctcaacaaccggggcgtgctcaacgtccagcggtaccggttcgccgaggcgctggccgatctgcaggacgccgaacggctcagcgacgcccaggacctgcgcctgctcggcgccacggtgcgggagaacctgggcttcgcgctcagtcggcagggcgagatcccggcggcgctgcgctacttcgaacaggccgagcagcggtacggcgtactcggcgtcaacgtgagctcgctgctgctggaccgggccgagctgctgctcgcggtccgcctcgcccccgaggcccgggtggtcgccgaacaggcggtcgccgagctgacccgcacccgcggccggttcaaactgccggagggacacctgctggtggccaccgcggcccagctcgccggggactgcggggcggccctgccggcggcccgccgggcggccgccgccttcgcccggcagcagcgcaccgactggagtgcggtcgcccggctggtcgccctgcgctgccggctcggcctcggcctgaaggtcgcggtggccgacctggtccgggtggcgcgcaccctggagacggccggctggcggctgccggcgctctagctagctagcggctgcggcaacgcgacggtgaccacgccgcggcggcggcgccggcctcggcggaccggttgacggcgctgctgggcgaggcggcgatcatcgagtacgtggagtccgccggccggctgttcgccctgctcgtggcggacggccgggtgctgctgcgcccgctcgggccggccgcccggatcgccgggccgctggaacgcctgccgttcgcgatgcgccgcgcggcctgcgggaccggacgcggcccggaagccgccgggcagctcctggccaccctgggcggccggctcgacgacttcctgatcggcccggtccgcgacgcgctcggggaccgcccggtggtgctggtgccgaccggcaccctgcagtcgttgccgtgggggctgctgccgtcactgaacggccgaccggtcaccgtcaccccgtcggcgacgctgtggtcccaggccgccggccggccgcgccggaccggccgcccgctggtggtcgccgggcccgacctgcccggctcggtgaccgaggcggcacagctgggccggctgtacccggccgcgacgaccctgaccggcagcgccgccaccgccggggcggtactggccgcgctcccgcacgccgacatcgcgcacctggccgcgcacggcagcttccggcgggacaacccgctgttctcctgtctgcggctggccgacggcccgctcaccgtgcacgacctgcagaccctgcccgcggtgccggaactggtggtgctcgccgcctgcgacagcggcctgtccctggtctgccccggtgacgaactgctcggcttctccgcggcgctgctggcgctgggcgcccggtcgctgatcgcggcgatgctgccggtgcccgacgaggcggccgcggagctgatggccctggtgcatcagcggctcgccgccggtgagccgccggcggtggcgctcgccgcggccgggcgggagctgacccgctccggcgggccggccgagcgggtgaccgcggccggcttcgtctgcctcggcgccggactgcagccgatcaggtgcggaaactccgggtcaggtcgttcagcgcctgactgagccgggtcagctcgtcggcggcgcgccgcgaatggtcggcgctgtcgcgcgtgcggtccgcgacatcgcggacgcccgcgatgttctcggtgatctcaccgctgccgacggcggcgttggcgacaccccggttcatctcgccggtggtcgcggtctgctcctcgacggcggcggcgatggtgtcctgcgcctcgctgatccgctggatgatttcggtgatctgctggatcgactggaccgccgccccggtctgcgactggatgctgcccacccgggcggtgatgtcgtcggtcgcccgggccgtctcctgcgccagatccttgacctcggaggcgaccaccgcgaagcccttgcccatctcgccggcccgggccgcctcgatggtcgcgttcagggccagcagattggtctgctcggcgatcgtggtgatggtccggaccacctcgccgatctcggcggaggccgtaccgagccgggacaccgtggcgccggcctgaccgaccgtgtcgaccgcggtgctggccaccatcgcggcctcggtggtgttgcgactgatctcggcgatcgcggcacccatctgctccgagccggcggccaccgtgtccaggttgcgggacacgtcggcggcgctgtccgcgacgatgccgatctgctgcgacgcctggtcggcgtccgcctgcagggcctgggacatgccggtcagggtgctggaggcggcggcgacctgctcggcgtgcgaggtgatcccggtgaccgtcccggcgatccggtcgatcgcccggtccagcgaggcgctcatccggccgatctcgtcgccgcgccgcaccccggtgcgctgggtcaggtcaccgtcggcgagccggtccaccaccgcgaccacccgctgcagcggccgccggatggagcgggtgagcagcgtggcggcgagcagggccagcagcaccgcgccggtggccagcaccaggtcgcggaccgtcgcgtggctccgggtccgggtcaacgtcgccagtgcggcggtacgttcggcggtcaccgagtcgtcgaacttggcggcggcgtccatcgccttcaggtacggacccgactcggtcacgttgctgatgtgcgtggcctgggcgtaccggccctgctgcacggccgtccacacctggtcgtcgatcgtcatgaagtcgtcgaggccggcctggaaatcggcggcgtgctgtcgctgcgcgtcgttcgaggccgacttgcgcacgtcggcgagcaccgcgtacaccttcgccttggcctcggtgaagaagccgtgcttgagttcgtggtcggaggcggtgtacgcggtctgcaggccgtacgcgtcggagaaccggaactgcagcagcgccaccgagcgggccttggggtcgatctgctcgaccacctggcgggcctgccggtcgacgttcgcccggacctgcccggcgctgaccgccagcacgatcatcagcagggcgagcgacccgaaaccggcccacagctggaaaccgagcgacaaatcgcgaaagttggggcgcatcacctcagattaaccatccggcacggacggcgtaccggcttcgtgccagggggtcagcgggccgacaccgcagcgtgcgtggcaccgatagagtgcgccgaaagtcgatccctaccggggaggatccgtgcccgctccgtatgcggcgtcgcgacgtcggtggttcatcgcggtgctcgtcctcctggtggtgctggccgtgctgaccggcatcgcgctgcacaagctgtggaaccggccccaggcctccggcgcgacgccgacggtcaccacctccttcggcaccccgtcgacacccccgtcgtcatccgcgtcggcggtggccggcgccgcgccgcagaccgcgtcgacccaccgggtcagtgggacgacggcgccggtggtgaccaggacgaccccgtccgggccggtgatcgtctacttccgggtcagtcagcagccgacctgcccgtccggtaccgaccaggtccagtacccgggcaccccggtcaccctcgcatggaaggtcaccggcgtcgacaaggtgacgctgtcggtggacggcccgggcatctacgacacgtacgacgccaacggctctgccgagatcaacttctcgtgcggcggcgaggcgaactcgtaccagtcccactcgttcctgctgaccgccgccggcaagacccggaagctggtcgtgaaggcgcgggtcaacgagatcgcccacacctgagttcaggacaggtcggcggcgtccagcgcggactgcggcgaccgcaggtacccgtcgctggtgacggtcgccccagcgggtcgacgcggtctgcccggtgtaggtggtggcctgggagcctccgctcagcccgtcgccggggcgaggcatcggccggtggtcagcgccccgacggcgccgagccggctgggatgccggccgatggccgcgtaggagaccgcgcacgcctgctgtcccagcgggacgccgtacatcaccgtctgcgacgggccaccgtccccgggctgcaccagcctcacctcggcctcgggatggccgatcgcggccagcgcccgccggaccgcggccacatcggcatccgccggccgatgatgctcggccggatcgctcggatccccatccgagggccgatgatgctcggccggatcgttcggatccccgtccgggggctgaggctcctccggattgttcgggtcccactccgagcaggcggtgcccgccgggcagagaacgccgtccagcgcggcggtgatctgctcggcccggctgtcccatccgtccggcggggacagcaacacccgccgtgggtcaccgccgatctcggcggtgcaatcccggagctggctctcgcgcaccatccgccggagctccgccgggctgggccgggcgccctcgacggagatcagcaccgcggtcgaacagccgtagccgccggtggagaatctctcccggtacgacttgatcaaagcggctcggatctccgcctcgctgacggcggccggcggtgccgcaacgtccggcggatccacccgccgggccgggccccacagcaccgcgaccacgccggccgtcatcaccaccagcaccagcaccccgggcagccgcagccgccgcggtgggtcatcgtccccgaatacgaacaccggaccacgctaggtgcggaaggttgcgacggcggttcccgcccggttgccggcgcccgggccggggtggccggggacgggtacgttgagatggtgactatggatgacgggcaggtcagccgggaggatcggatcgtcgccgagttcggggacgggcatgacgtggcggggatcgccgcccggtacgggatcagcgtggagcaggtctacgcggtgatccagcgggaggtcgggccggcggcgccgagcccggtcgccccgccgcccgggtatcaaccgccgtacggttaccagccgccgcccgcatcttatccgccgcccgcctatccgcagcagccgacgaactacccgcctggggcttacccgccgcctggggcttatccaccgcctggggcttatccaccgcctgcggcttatccaccgcctggggcttgtccgccgcccccggcctacccgccgcccggccactacgggccgccggtgtttccgcacggatctcctgaggtggacgcgatcgtggcggagtacggggacggccatccggtcgaggagatcgcgcggcggcgggggctcagcgtcgatcaggtctacgagatcgtccgtcgcgatctgggatagcgggacaacggcgtatcaggcgggcgcgggctcgggacggtttgatggaccacctccggatgcgcacctacacgccgcgcggtaggacgaacggccacgcaccgcgggcgtcgtcggcgtgagacggggccggctatccgcgtacgccgcaatcgtcatggcggcgggcggagcggaacgcccggccgcgacagggagtggctgtcgcggccgggtgtcggtcaggctttggcggcgcggcgggcggcccagacgaccagcatggtgcagatcgcggtgagggccagggtggacaccgtgaccgcgttctcgaaggtgtgcgcggcggccgggctggtgtcgacgccggtgagggagccgctgaccgcggcggcgacgatggtgccgatgacggccatgccgatgctgccggcgacctcctgactggtgtcgctgagggcggcgccggtggaggtctggtcctcggggaggccgcgcatcacggtgacgccggcgatggtggcgacgacccgcatgccggcggccgtgagggccaaagcgatggcgatccagacgtagtcgtagcggccgagcagggcgtagatcagcaggccgccgatgaccgcgccggcgccgagcggggcggcgatccgggtggtgagccggtcgacgatcttctcgacgaacgggccgatcgccagcatcacggcgacctgcgggaggttgccgagcgcggcctcggcgggggaccaaccccagaccacctgcaactgcagcgaggcgctgtacgacacggcggccatgccgaggccgagtgccgcctcgtaggccaggctggcgccgaccgcgggacgcttgatcagggcgaagtcgaacagcgggtgcggggtgcggcgctcgcggacgacgaaggcggcggcgcaggcgagggcgccgaggccggccagccacggggcggcttgcgaccagccgtcctcgacggcgagggtggcggtccacagggccaggatgatggtggcggtgccgaacagggcgccgggcaggtcgagcggggtgctgttgcgggcggccgggtcgtcggcggggatgccgcggcggatgcagaccagcgcgaggacggcgatcgggacgttcatcaccagcagcgtctgccatggcaggacctgcaggacgaggccgccgacggtggggccgacggccatcccgaccaggccgaccgtggcgatcagcgaggtggcgcgcatcagcaggttctccgcgtcgaacaggcggaagcagagcgccatggtgccgggggcggtcatcgcggcggtgacgccgacgacggcgcggaccgcgatcagctcgccgggggtgcgcaccagcaggacggccagattggcgagggtgaacagggacaggccgatcagcatcatgcggcgggtgccgtagcggtcggcgaccgcgccgaaggccatcatcaggccgccgaacagcagggagtacccggaggtgatccactgcaggtcggcggtggacgcgttcagctcgcgggcgatcctcgggagggccacgttgagcacggagttgtcgagcatctccaccaggaagaccacggacagccccaggatggcgggccagacggcccggagcgaggtggcgtgcaccttgtcggcgggtgcttccaggactgcggcactcatcaggcacctccttcgattcgcattttggaacggcgttccagtgaagctagtctggaacgacgttccagtcatgtcaagatggggtcatgcggaacacggatcggcgcgcggacgctctgtccaaggaacggatcatcgaggccgccgtcgagatgctggatgcggcgggggagagcgggctgaccttccgggcgctgagcgcgcagctcagtaccggggcaggcgccatctactggcatgtggcgaacaagggcgagctgctggtcgccgccaccgacacgatgctcgccgcggcgatggcggtcgaggacgcgccgcgggcgccggccgcggcgatccgggccatcgcgctcggcgtgttcgacgccgtcgaagcgcatccatggatcggcgaccagatgacccggctgtccgggcagtcgtcgacgctccggatcttcgaacggatcgggcggcacgtgcaggccctcggcgtgcccgaggcggcccagttcgacgcggcgtccgcgctgctcaactacatccagggggtggcggcgcagaacgcggcactgtcccggtcggtgacgcaggggacggaccgggccgacgtgctcgaaacggtgtcggcgatgtgggccagcctggacaccgacgacttcccgttcctgcggacgatcgccgggaaactgcgcgaccacgacgaccgcgagcagttcgtcgccggcatcgatctgatcctggccggcatcgagagccgctggccggccgggccccgggggcttccgcgagacgttggcggcgatcggcaccctgatcggtgttgatgtcgaggacgacttgagaaacgcgccggtgctgtcctcgagttgacggcttggcggatgagtggccggctttgcgtgctggtgcacgaatagcggttgtcgatcgagcccgataccgtcccggacatgggcatcaggtactcagcgctcctgcgatggggcgccgcactcgtcaccgccggcgtggcgtcggccggctgtgggaccgtctcgctccagggcgagtatccggcgcgcgacgccgagcaggcggcacggcggctcaatgacgacttcggttaccgtgaccgccttcggcaggcggagtacatcgccgccaccgagatacccaccacggcacagggcggcaacagcgaggtcggcgagacaccgctggcctggtccgggcgggtcttcgccgacgagaaggccaccatcgacatccgcttcgcagtgcgatcgcccgattcggcgcccaccgaggagttgacccggtgctaccgctacacccttcagttgtaccgctacaccagctatgacgaaatcgcctgcccggcggtcgcaacgccaccggcgccctcggcctcgccgccgctgaagttgccgcccgacgccgaggcccgactgagcgccgcgctccgtgacgccacacccgaaacacttgccggccgcgtccgagccgccttcccccatgagggcatcacggtggacaccgtcaccgacaagggcaccctggtcgccgcggtgggtgtagccgccgagcgcgaatgcaccgtcgtgatccggaaaacggacggtaggacgacgccggtcgccttccgcgccaggcaactcgaacccggcgagacgggctgccgaaccagcctgtacacacacccggcgcagtaggcccgcccgagtacaacccgatcccggccgtgtctgcccggccgagcccgtgaaccgtctttcttcttcccacggacatctgacgaacccgagaggtgcaggccatccgcgacacccttttcgccgccgcgtgggtcacgggcaatgtagcgagatgggtacctggtcgaggccaccggcaggcgatcgaaaatcagggattctccgccggtccacgcacaaggggaatctgcggattcagggcgaggatccgggaagcgacctcaccatgcaggtccgccaggacgacctcgtcacggttcactcgcgggtgctgcgcgatcaacgatcgatgtgtcagccggtcggatatttgtgatgcccacaaggcgacaagcccgggaaggaacatccaggaaatccggaacgatacggggccggtgagcaaccaggcagtacacacaccgaccacggccagcgcgatcaccacatgggcccggcgaagccacctcgagacagtgttgaaggcgcaactgcgtgcgatcctcttggcggacgtctcgtcaacgtgtatcggcacccggaggggccgccgaaatgcgggccctccggtacaacaagcgaggatcaacctcggatcgggagtgccgtcgacaattgatcggttgggcgcgcgcaaggtgatcggcttcacggggaatgcgtagcgtcgcgcgccccatcaccttctcctgtcaacgcttcgccgcatgataatgggatggcgctgatacagccggaaaatgtcgccctctcgggaatcgtccgggaggtggccacgccgatggccatgaggtgtgttcgggacggcaccaccgtcggggtcggcgtcatcaccaggccctcgggtcggcgatcaggtgccgcttccggccggtgaccactccacggtccggcgcatgcaggcgcggggccagcggtccaggcccagcgcggcctcgtgggcgcggacggcgcgcagcccgggagtgatctcggcgctgccgagctgccggaaaccgcaccggcgatagtacggcgcgttccacggcacctcggtgaaggtggtcagggtcagcgccgggatccgcgcggccgcggcgtgggcggcgaggtggtcgatcaggcggcggcccaggccctggcgggcgtggcggcgatcgaccgacacctgctcgatgtgcagacagccgtcgaccgggtcggcgatcaggtaggcgacgggtcgatcatcggggtcggccgccacccaggcgagcccggtgcgcaggtagcgggtcagctcgtcgatggtgaacgggtcgtcgtcggcgatctcgggcatgccgatgtcgcggaactgctcgccggcggagcgctcgatgtcctgaacggcgagcaggtcgtcggggcgcatcggtcggatgatcatcgcgggagtggacctccggccaggacgatggcgacgccggcggtggcggccgcgagcagggtgaggaccggaccgcggcgcagggcgagggcgagcgcggcggcgccggcgaagaccgcgtactgccagggctcggtgagggcgcgcaggagggggaccgcggatcccaggatggcgccgatcgcggccgggccggcgccgtcgaggaaggcgccgacccgccggttgccgcggagccggtcgaagcggtgcgcgccgagcaggatgaaggtgaacgacgggctgaacgcgacggccgcggccagcagtccgccgagcaggccggcggcggcgtagccgacgaccgcgacggtgtgcacgaccgggccgggtgtgatctgcccgagcgcgaccgcgtcgagaaactccgcggcggtcatccagtggtgctgcccgaccgcgtcggcctgcatcagcgggatgatcacgaagccgccgccgtaggagagcgcgccgaccttcagcgcggtccacgccagcgggagcagcgccgcgccgccgaagaccgcgaccagcggcgccggtcgctgatcagaaacgggcaggcgctgggcggcgatctcggcgatgccgcacgcgatcaggaccagtacgagccacggcccgacggttgccgccgccaccgcgccgagcagcaggtatgccgcccaccgcacgcgtaccgcccgtttccagctggccgggacgagcatcgccccggactgcagggcgatcgccgcgaccgccgatccggcgcccgcgccggcggcccgcacccaggtcggcgggtcgccgaggaacagcgcggccagggcgaggatggcgaccaggccgggcacgatgaacgcgaggccgcccaccagggcgccggcccggccccggacccgccacgcgcagtagatcgcgagctgggtcgaggccggcccgggcagcaggttgcacgcggcgatggcgtcctcgaactcccgcgcgtcgatccactgccgccggtcgacgcacagttggcggaacaacgcgatgtgcgccggggggccgccgaagccgagacacccgatccggccccattgcttgatcacggtagcgaggctgaccacgccggcagcgtacgacatctgcttccgcccatccggcacgcgctgacgtcctgaccggagcgcgcatcgcgccgacaggccgataaccaacatcaattccccttggctacagtgctctccatgccggacgtcgcactgccgccgttgtccgctgccgcctgggctctggtgggcggatcggtcgtcgaggcgctcgaactcgccggtgcactgcgccgggcgaaggcgctgccgtggaagcgtcccggcgagccgagacttcccgcatacctgctctcggtggtcctccggctcgccgccggagccgggctggccgccgtcttcggcgcggacggtcagctcggcgggccgttcgcggccggctcactgggcatcaccgctccgctgatggtggagaagatgctcagacaggtcggcaaacccgaggtcgaggacggcaccgcctgatgccggccggggacccgtcgttcggccgtcaactgctgttggctctggccagatccacgcccgcgttccacccggcccgggaggctcggcgggctgacagcacgctcctggacgcggtcgctcgacgcaccccggccttcaccggcgaccagccccatccggacccggtcccgttccgcggcacgttcgccttcgcccggcccaccatggcgcgccgcgggtcgcgatcgctggccccgctgctggccggcctggcaacggtgctgttcgcggcggtcggcagcgcggtgctggtggccggtgcgggcggccaccagcccaccctgccccttcccggcctcaccgacgcgaccggcaccgccaccaccggcggcccgccgcctgacgcgagtgcctcacccaccggcagcgcggcggcccagggcgccgccatgaaccagttgctggaccgcagcagcgcatcccgggccgagctgaacgccgcgatcatcgcggtgctcgcctgcgagaaggtggacgacgccgtcagcagactgcaggccgtgggcgtcgagcgcgacgaacagcggtccacgctggcgagcctggacctctcggccatcccgtccggcgaagcggcgcgggatgcgctgagtgccgggctcacgcactcgctgaacagtgacgtggcctatgtgaaatgggcccgggaaagaaacagcgccgggtgcgccgacaccccggccgccaaggtctaccggcaagccgctgatcacgagtccgcgtcctccgccgtggccaaagagcagttcctggccctgtggaacccgatcgccgtctcgctggggctgccgtcccgcggtcgccaggacctctgaccgcccgatctactcgccgaggcgtttgcgctcgacgaaactggtggcggtcaccacgctcagcggcggcacatccttggcgatgaccgcgcccgcgccgaccaccgagcccgcgcccgatcgtcacccccggagcgacggtgacggccgcgccgatccacacgtcatcctcgatgacgatcggggcgtgcgtgatgaaatcgaaccgctcacccggcgccaccggatgcccggcggtgctcagcgtcacccgcggtccgatcagcacccgatcgccgatggtgatgccgccgaagtcgagaaaatagcagccctggttgatgaagacccgctcaccgaatgcggcgcccagaccgtggtcgcagtagaacggcggcagaatggtcagcgagtccggcagcgccttgccgaagatctgggccagcacggcccgacgcccgtcgagatcgtcgaagggcagcgcgttgaggcggaaggtgagattcatgacgacctgcacccgctccgcgaatgcccgggactcgggcgtccgggtgggtaggcgttgctcgttacgcacgggtccatgctggcatgtccgctcaccctggagccgtcccggtgaccacgccacctgaacctccgccgttgccgacggctcaggcgcttcaactcggtgcccacaacgtccagtacaacttctccggcggtgcggtgccggttacctggccgtgccgggccggggtggtgccgccggaggcggactgccggcagagccggccggccgaccagacgctggccaggccgtcggcatcgcgcgagggcacggtcgctcaggtggtcaccggcatgggcggagtcggcaagacgcaactggtagctcacctggcgcacgacttgtggcggaaacgcgaggtcgatctcctggtgtggatcaccgcgacttcccgacggaacctggtagccggatatgccgaagccgcgctgagggtgttcggcatcgaggagggtgacgtggaccgtgccgctcagcggttcctgacctggctcgccgagccacacggccaccggtggctgatcgttctcgatgatgtctcggacccggcggacctccgatacctgtggccgccggctgaagccttcggccggacggtggtgaccagtcggcgccgggacaatgctctgtgggccgggcgacaactgatcgagctgaccgtgttccgtcctgccgaggccgaggtctatctgaaggcgaagctggcggcccgcccggcagctctcgacggcgccgccgaccttgccgccgctctcggtcatcatccgttggctctcgcccaggcggccgcctacatccttgaccgcgggccgcgaacgtcctgctccgcgtatcggaagctgctcaccggccggcggcgccggctgtcagacctggccccggacgccctgcctgaccagcagggggtgccgatgtcggcgatctggactctgtcgatcgagcaggccgcgcgactggccccggtcggcttggcacagccggtgctcgaactcgccgccctgctcgatccgaacggcattccgatcagcatcctgacaaccacgtcagtctcagcgttctgcgccgagcgggtcgatcgcgagatcgacgccgacacgatcgatgaggcgctgcgcctgttggctcggttcaatctgctgtccctcgacgatgcgaccgagaccgctcacatccacgcaatggtccaacgggccgtccgcgaaacactgactccggacgcccgtcggcgtctgtcgacctgcctggccgacgccgtcttcgaacagtggaggaccatgcgccgacgagaggatgcgatggctgcgaatgtgatcgcactcgtggaagcaaccgacctggatctgtgggacccggagggcaacctccatccggtgctctaccgcaccctgcatcgcatcgccggtgagggcgagcaaccgtcgacgagcttcctcgaccacctctaccgtagaacggtcgagcatgtcggcatcgaccacctgagcacgctgcgactccgcatctacctcgccgtccgtcgtggcgcttcaggcgacatgtcgggcgcggtcgacgacttcgaggcgctggtcggggattgtgtccggacgcttgggcaagatcatgatgaaacgctgaacgtccgccgcaacctcggcgagcacaaggcgcgcgccggagacacgatcgggggaatcgccgacctggaggcggtgttggtcgactgcttgcgcattcagggagccgaccacccgaacaccctcggtgcccgcttcaacctcgcgaagtggcgcggccacaccggcgacccactgcggagcgccggggaattcgacaatctggtggcggctctcactcgggaactcgggccggacgacagcaacaccctggcggcccgatggaacgctgccagcttccgaggaatggcgggggaggggcggccggccgtcgaaatgttcaccgcgctgactcgcgactatgttcgcttggcgggccggaatcatcccgtcaccctcgaggcccgccttgaactggcgaaatggcgcgctgtcgccggcgacacctcggatgccatcgctgaccttcgcgctctggtggaggacatggtgcgggttctgggcgcggaccacgcccagaccaggaaggctcaggatgatctcgacggcttggtgaattcgcctatctgaggttcacgggccggcgcggtcccgaccgtgactgtcgagcgcggccggtcattccgcggaggcggggtccgccgcgtccgcgatcggcaaccggttcgcggggatcgtccgcaggccgtcgaactgcacgaagatggtgcgccgctcgatcgcgcgcccggccgggtcgatggagtacccgcttatccagatccagccgtcgtacgtcgtccagtcatgcacctggatgacccggagcaggatgggtttccggaactgcacgctggccgcgctgccgacgcggaggatgtcaccgggccggggcagtgtcatggcgacggcctttcccgccggtcaggtcatggtgccgttgcggcagttcatattgcggttgtacgtccatggaagctccctgtcgatcaacgaaccgcacgggtgtggttgccggccgccgcggggcaccggggtcgtggactctcgtcgccgcgggatcggcgatcgtcgtcgactgtggagtgggcggctcggtcgcgatagccagagtggcactgccttcagggggcgtcaatcttatgccgtaacttttcgttcctcgaaagagggacatcactatggatcttccacctaacgccgttgccgtatgccgacgaagcgagcacgatgtcctcgatcgattccggcgagggaagtggagtccgccatggcgcgcccgatcggcccgaccatcccgcgctggcagctcggcgagcagttgagtcagctgcgcacctccgccggcaagtcgcagcaggacgccgccaaccgtctgggctgctcgatcagcaagatccagaagatcgagggcggcgaggtcggcatgaaaccggtcgagctggaagccctgctcgtcctctacggcgccccggacgcgctgagcggccagttgcaagagctgcgcaccctcggcgcccagcgtggctggtggtcgaaatacggtgccgtctccgctccgttctccacctttctgggtctggagagtgccgccaccaaaatcaggatcttcgagccgctcatggttcacggtctgctccagaccgaggcttatgcccacgccttgaccgaggcctccaatccctcgatgccggatactgaagtagaccgacaagtccggattcgcctggagcggcaggaccgggtcttcctggaggagccgccggagatctgggtcgtgctcgacgaggccgttctccgccggcagatcgggagtccgcaggtgatggcggaacagctcaaccacctgctgcgcctgccgaagcgggtgaccgtccaggtggtcccgttcgccaacggcagctacccgggcacgctgggcgccttgacgttgttcgagttcgcggaagagttgcacagtccggtcgcctacgtggaatcccaggcaggcaacctttacctcgaacgggaagacgatctggcgcggagtaacgtctccttgaaccacatcaccgcggcggcactcagtaagcaggagtcccgtgagctgatcgccgcggtcgcccgccagctcgtaccgcagtagtaggagccatcgatggacaagtaccacgtcaatcttgccgacgcgcagtggcgcaagtccaccaagtccaacgccaacggcggatgcgtggagatcgctcaggttgacggcttcgtcgcgatccgggactcgcggaatccggatcgtgagccgctgatcttcgacgccaccgagtgggactgcttcctcgacggtgtcgcgaagggtgagttccccgttccgcgcccctgagctcggtcgacggcccggtcaccgcaaccggtggccgggccgtcgtacgcccgccagaacgctccccgaggctaacccctccaccggcgtcgatcgatgttttacgacgtaacttcgagaatggcacgttactgtgcaacttgcaggtcggcggcctgcttccccaggaacgcggcgtgccagcggtcgaagtcggcggccggcatcggccgggcgtagtggtagccctgggcgatgtcgcacccgagttcacgcagcgccgcgaccgccgtcgcgtcctcgacaccctcggcgacgaccgacaggcccaggttgtgcccgaggctgaccgccgtccgcaccaggaccgcgtcgccgtggctggtcgccatcccctggacgaacgacttgtcgatcttcaactcgtcgaccggcaggcgctgcaggtagctcatcgacgagtggccggtgccgaagtcgtcgaccgacagccggatgccgcccgcgtgcagggcgtgcaggaccgcgaggcagcgctccgggtcggtcatcaccaggctctcggtgacttccagctccagcacggcggccggaacgtcgtacgaccgcaataattgaaagatctgatcggggaagctcgggttgagcaggcagcgggtggacaggttgacggcgaccgggaggagccggccgtcgcggcgccacgcggccgcctgacggacggcgatctccaggacccgggtggtcagcgggtggatgaggctggtggtctcggcgatcgggatgaagctgtccggggggatccggccccggtccgggtgctcccagcggatcagcgcctcgacgccggccacccgctccccgtccagctcgatcttgggctggtagtggaccgtgagctggtcgtcggtgtccagcgcgcggcgcaggtcggcgagcagctgcagccggtgcgccgggtcggcgtcctgcccgggctcgtactcgtgcacaccggtggcctgttcggtggccagttgcagggcgctgccggcgtgccggagcagggtctccgcgtcgtcgccgtgccccggcccggccgcgatcccggcgctgacttcgacgtccaggctgacgtcgccgagggtgaaagccggccgcagaacctgcagcaggtcgtcggccacccggtgcgccccggcgaggtcgccgccgggcagcagcaccgcgaagtcgtcggcgccgacccgcgccagcagcgcgccggacggcaccgccgcggacagccgccgggcgacctgggtcagcaacaggtcgccgtgccgggtgccgagcaggtcgttgacatccttgaagccctgcaggtcgaacagcagcacggcggcccgctgcccgccgtccagtgcggcgccgagacggtcggcgagcagggtgcggttcggcaggccggtgagccggtcgtaggtggccgaccggcggaccgcggtcagataccgccagccgctgacggcggagatcaggatgatcagcagcgcgccgagcagcagcgcgagcgatccgatgctgagaccgtgggtccagccgcggccgaaggcgggcgcggacaccgcgagataccagtcgttggcgttgccgcgggtggcgtggatccgctggtacgcgatccgccgcccgcccagcgtggtcacaccgtgatcgccggcgccgggcggcagggcggcggggatgctgccggtgcgggtgtcgaccaggacgtggccggtctgcgcgtcgacgatcgacgcggcgatcgagccggtggtgccggccatccggaaactgtccagggcgatctcgaagtgcacgatcccggtgtgcccggcggcccgcacggtcgtcgagttcgagatcaccgcgttgtgggtgtccgtcgactcgtactccttggcctggtacacctggcccggttcgagcgccagggtgggcgcgaagaaggcgttgtcgtcctcgtcccgcgacaggtcgtcagggccggccggggtgctgtcgacgacccgggcgatctcggtgccactgctgtcgatgaaacaggcctcaccgatccgcccggggaagagggtctccaggtagccgagcgcctcgttgacccggcgcagcttggcgggggtggcgggtgccgcgtagtagtcgctgaacaccgggttgtcggcgagcaccgcgtcgatcgcgcgggcccgctcgaagtagttctgcagagcctccacctgacgccccagggtgacgtcgagcgcgtggtcctgcgcgtcgacccggccgcggcgcaccgcgagcacgctcgtcaccacgctggagatcagcaccagcacaccgatcaggaacaccgtcatccggacggtccgatcgatcttccgcttgcgggagcccagcgtcgcagccatcaaggatgaccatcggacgctgagcccccggcgtgagccctacggacgaatcggcgccgccgcgtccgcggtccacgggacggcgaggcccatctccggcaccgtgcccagctcgatgtccagctcaccgccggtggccgcggccgggcgccggaaggtgaacgggtagctgacggtgtcgtcggacggcggggccgggaccgtcacccggaaccagtccggctcctcggtgaccttcggccagccggcgccggagcgttccaggccctccggcgggaagaacgagagggtgaactgttccggtcgcgcaccccggtgacgggtcacggtcacgatggtcgtgccgtaccggaaaccgtccttctccggcccgagcgtcagcggaccggcggtgatcgacgcgtccgtcacgtgcgggttgaccggcatccttcgtgggccgctgacctgcacgaacttgccgctccgcagggcgtagccgcgggtctgccagatctgcggcgtacggtcgtcgcagcaccgctgatagtcggcgacggccgtggtcagcaccccgccggtcaccttcgggctgtccgcgcggatgtcccggaccggtccggtggtcgccgccacccgcccgagggagatgatcgcgccggtggcgtcccggtcgtacaccacgacctgtttgctgccgccctcgatgagacaaccgaacgtgacgatggtttcgtccgcaccgtcatgatcgacgtcgccataggcgaccgacaggatcaggatcgagtcaccgtacggcggttgcccctccgccacgctccctccctcgaccggcacctgaccccggtggaagtgcaggcgcccagacggtccccgcacgttgtccgcgggccaggccgggacgtcgagcgtcgcctcccgcaggtcggcgagcgagatccgcccgttcggcgcggggtcgggcgcggcctgcgcggacgatccgatcggcagggtcacggtgagggcggcgagggccgcgagcagcttcggtctcattgcgcgccatcctccgccctccgagcccgtttggtgtcaccgttgggagtaattcacccgatttgggcacgccgcccggatggcgtctgccagccggtcgacatccgccgcggtggtgtcgaacgacgtcatccaccgcgcctcgccactcggccagtcatggaagagaaactgctcgtgcagcgtggccagggcgtccgcgggcagccgcgcgaacaccgcgttcgcctgcaccgggcggtcgatcgtcagccccggcaggtcccgcacccggtcggccagccgggtggccatcgcgttggcgtgccgggcgccgcgcagccacagatcaccctgcagcagcgccaggaactgggcggaggcgaaccgcatcttcgacatcagctgcatcgacgacatgcgcagatgctccagcccccgatccagccgcggatcgagcaccaccaccgcctccccgaacagcatgccgttcttcgtaccgccgaacgacaggatgtccactccggcgtcggtggtgaacgcccgcagcggcaccccgagatgggcggcggcattcgcgatccgggcgccgtccaggtgcacgaccatgccatgctcgtgcgcgaacgcggcgatctcgcccacctcgtccggggtgtagacggtccccgactcggtggcctgggccagcgacacgacctgcggccgggcgcggtgttcatcgtcgaaaccccacgcctcccgccggatcgccgccacggtcagcttgccgtgcacggccggcaccggcagaagtttcagcccgccgacccgttccggcgcgccgcactcgtcgacgtggatgtgcgcggtgtcgacgcagatcaccgcaccccaccggtcggtggcggcctgcagcgccaccacgttcgccccggtgccggtgaccaccggataggtggtggcggtcgggccgaaatggtcgcggaagacgtcctgcaggcgggcggtcaacgggtcccgcccataactctccgcatgcccctgattggcgtccgcgagagcggccagcacctcaggatgcgccccactgtgattgtcactggcaaaagagatcaccccgccagtcttacagcggacatcctgaccggccgtccaacggaaggctgcccgcactgtgccggccgaccgcgtacacctgccggatccctaccagcccacccggcgtgacctcggattcgccaccgccatccatcgccgcctgcggtcgggtggatgcaggtaggtcgccgttggccggtactctgcggctcgtgggcggagggatccggtgactcagaagtcgctgcggctggtcggctactgggacgatccggcggcgccggacggctggccggatgtccgcgacttcgtgtgcgcagacgtcgcggcgcaggagcgggacgcggtcatcgcgtatctccgttcggggaccgtggtcgtcgccatgtccggtatttcggtgtgccacctatgcggggtgggcaacggaagcacggaactgaccgacggcgaacatctgatctggccggcgggcctggtgcactacgtggagtcgcatgatgtccacctaccggaggagatcctcgcgatcactcgtcgaggccctgctcggcccgtcgaccctcgtgcgttcgagcgggcgttgctggagacgcacgaactgaccgtcgacgaacagtggtggcgagcgctccggaggtagcgcacgctgccgcccgctccagcccgcaatcgccttgccctggcggccggatggtgatggtgtcggccggtgcgagggatgggggctccggtggtcacggtgtgggtggacggttggcagctggaatgctgcggagagccgttcgcggtgggccaggaggtttcctgggtgctgcgggatctcgatcgcgagtggttggcgagtttcctgggcggtggcctggccggcagtgtcgacaaggcggaggagcatcacgggaacgagccggaaggcgtgccgccgacggtcgggaccgtggtgtcgatcgaggcggtgcactgccggtacgccccgctgtcgccggacgtcaacgggctccatccggtcgccgggtccgggaccacggtatcggtgcggaacaccgcggtggcggggcaggaccggggtgacctcacgttcgtcggctacctggtggggttggccgtggacgagggggcgtaaccaccgcagctgagcacgtcaccgggcggggcagtagcgtggcgggatgcggcgggcaatgggttctgagctgggcgctgcctccttgacctatcgggaggtcggtgccacccgggctgagtcgatgccggagggctacgggcacgtgacgcgtgacgtgcggttgggagacggcccggaggtcttccggcgggccggggccgccctgctcggctggcggatgcatgaggaggccgggctcaccgtggtccacgccgacgggcgggccgcggccggggtcaacgtggtcctgcgggtcggcgggagcctgatcggtctcgccattccgtgccgggtggtgtacgcggtcgacgaaccggatcggtgtggcttcgcctacgggacgctgcccggtcatccggagacgggtgaggaggcgttcatgctggctgtcaccgggaccggagaggtccgcttccgggtccgggccttcagccggccggcgtcgctgatggcgcgcgtgggcggcccggtcacccgcctggtccagcagtatgcgaccgatcgctatgtcaccgcgctgcggcgcctcgcccaccggtaggggacacccggcggccggtgcggtcagggagaaccggctccacgcgcccgggtcacggctcgccactgccgcgctgtcgccggccggtggccaggatccagaagccgcccgtcgcgccggctgtcaccagtgtcagcccggtgatgaaatcggccgcgcggtccggccagggcagggccgcgggggtggtgaacaaccccaggtagaacggctggatcacggctccgacggggacgacgagccgggccccgatgccccagccgtccggccgacgggcgatcgcgccgaccaggccgagcggtccgcccaggatcaccgcggccaggaaccacgaggagttgtccgcccagacgcccgcatcgaacatgcccagggcgaggcccacgccgtagtgcaccacgcaggcggtgagcagtgcgatgatgccggcgacgacggcctgggcgcggccgcggacgagccacccggacagcacgcccagcccggcccagagtgctcccgcgttgaccagctcgctgagggtcatccgagcggccaacagggtgttcgccctaccctccagctggctcaccgtcgtcacgttggaggcgagcgccaccagagccaggacgctggcggcgatgaacatcaggacccatccccgtcgattcacacccggacgttaccgagctcacgccacgtggcgggcccgggtggccggcggcctgccggtggtgcaggtggcgcgccagccaggcggcgagtgcagcgctgagcagcatgtcgtagcggcccagcgcggcgaccagcaggtcgaggagggcgaagaaggtgagcaggccgatgatcacgcgaaggccgtcggctccgtacgggcccgtggtcgcgagccgggcgagcagcagggcggcgacgacgacggggagcagagccagggacaggccgaggggccagggcagaccggtcccgggcacggcgtaggtgaggatccagtgggcggccgccccggtgaaggcgatcgccccgagccgtcctcgggggcgggatccgtcgtcccggcgggtcggcgtccgccggcgcggtgagtggccggcggcggcagggggtgcgccgggccggcggcggccgaccgggaaggcgagcgcgatgacggcgatcagcagagcgccggtggcgaccaggacggcggccggcggccgctgggcgaactcaccgtagatcagcggcgtggcggccagcgtcaggccggtcagccccagggccgggcgggaggcccagggacggtcgcgggcccgggggacgagcgcctccacgaccaggatcgcggcgccgatgctgatcgtggtgtggaagacggtgaggtgcgcggcgagcagcaggttggtgtgcccgacgacgctgtaggagccgatgccggaatcggtccagaaggccgggaggaaccagtagcggtcgacgaggccctcctcccagatggcgtaggcgacgccgagcaggatcaggccgggcaagcccagccggaaccggtgggcgatgtcgcggcacacgagggcgccgcacccgtacagcgccatcatgaaagcgagcctccccggcatcagcaggtccagcggtgggctggagccggacaggccctcgccgaagaacggggccagcaccaggatgcgcagggccgggctgccgagtgcccgtcggagtgtggccgccatgggaacaatctcccggcaacggccccttcggcgcatccgtccaaagtcgatgattcatataccaaagtttcggcatcgggaccggacgaggccgtggcggccttatagaatcgggctgggaaacggcgttgcaaggctaggaaagtgcatggaaaagcagcggaaacggcgattggctcgtctcgggggcgcgctggtggtcattgtcgtcgtcgggctggccggggcctgttcccgcggtgagcagacgtcggcggccgcctcggtgcggccggccgccgcgaccgtcgccgtcccggcgactccggacccggcgaccgcgacgccgacccgggaggcctcccggaaaccggccaccaggaaggctccggccatggtcagggtgcccgacggggtcgggcgggactaccagtcagcccaggacatctggcgcgccgccggcctgatcgtcgccccggccaaggacgacaccggcgcccaccgcctgccggtgatcgacgcgaactgggtcgtgctggcgcaggaccgcaaagccggctccagggtccggaagggctcgctgatcaccgcgacggtgaagaagtacagcgacgattgaggcaccgcgggccgagaccgcggggaggggcccggaccggcggctgaccgtcggtcagccctgggcggcctcctgctggatctgcgggaactgggcggccatggcctccgccagggcctgcgcggcggacagcggacggaccatgaccatgaactcgtcgatcaggccgtcggcgttcaggtgcaggaagtcgcagccggtgagttcccggccgccgacggtggcccggaagaccagggcgtggtcgcgctcgtcggagccggccagttccgtgacgtaccggaaatcctcgaagacgcgcaggacggcgcgcaggatcgcggcggtgaccggctttccgggatagggcttgtgggcgaccggactggtgaagacgacgttgtcggcgagcagggcttcgatggcggcgctgtcgcgcgcctcgaccgcttcgcggaatgctttcacgacgattccttaaaggtctgatccattgacgggtggtgatcgccgaaatgcgggcgacgatggcggccgctcacacggtgatgacgatgccgatggcggccgggcgcttgatgtggaacagccgggcgagcgtgccaccgatccgggccgtgacgtaacggctctccagcagccgccgggcggcgtcggtctgcgaatccgggagcagcaccgccgtcccggcgatggtctgcgcgccgggcgggacgttgccgcggacgtcgcaggcggtgatctcgacccgcgggttgttgcggatccgcttgaccttgccggcggccgcggcggagaccgtggtgatggtgtcgccggacgccacgtgccagaccgcggtggggaccggcgtgccgtccttgcggaacgtggtcaggctgatctgcttgctcgcgatgatctccgcgggaatgctcatgccgcgatcctaggtgcgcggtcaggcgaggtcgaactcctcgaagaccagaagggtccgggtgttcaccactccgggcatgccctggatctcgtcgaggacgagtcgtcgcaggtcggtgttgtcccgggcgcggaccagcaggatcacgtcgaattcgccgccgaccagggcgatgtgcacgacgccgggcaggtgccggaggcgttcgccgacctcgcgccattcggcctggtgcaggttgacggtgacgtacgccgatgtcgtcatgccggccgcgacgtggtcgatctcggcgcggaagccgcggatcacgccggcttcgcgcagacgctgcacccgggcgtacgcgttggcccgcgagatgtgcagggtctcggcgagctgccggatcggcaggcgcccgtcccgggtgagttcggcgaggatgcgccggtcgatgtcgtcgaggtcgctggccacctgtctccgtctctgggtccggcgggccgtccggttggacggttggctctgcggagccgcccgcggaacgcaattttctcgatctgtctcagattatggaacataggtgaccggcgacacacgatatcggcatgacgcctgacccccgccggctcttgccgtccgacagcccggtgaccctgatcgctcccagcggcgccgccgtcggcgaggtgcccgaagacgccgtgctgctccgttcgctcgccgcgctgatcaccgcgcggcggctcaacgaccaggcgtacgccctggtccggcaggggaggctggccgtctacccgtcgtcgcacgggcaggaggcctgccaggtggccgcggcgcaggtgctggacgcgaccgactggttgttcccgacctaccgggacacggtcgccgcggtggtcaagggtgtcgacccggtggaggcgctcagcctgctcaagggcgattggcactgcgggtacgacccctacgagcaccgggtggccccgcacgccaccccgctggccacccagctgccgcacgcggtcggggtggcgcacgcggcccggctgcgcggcgagccgaccgtggtgatggcgatgtgcggtgacggcggcaccagcgagggcgacttccacgaggcgctgaacttcgccgcggtcttccacgcgccggtggtcttcttcgtgcagaacaacgagtacgcgatcagtgtgccgctgtcccggcagagcgccgccccgtcgctggcccacaagggcatcggttacggcattcccggcgagcgggtcgacggcaacgacgtggccgcgctgctcagcgtgctgggcgcggcggtcgcccgggcccgggccggcgaggggccgcagctggtggaggcgcacacctaccggatgcaggcgcacaccaacgccgacgacgcctcccgctaccgcgacgaggccgaggtcgccgcgtgggtggagcgcgatccgatcacccggctccgcacccacctgcgggatcggggtgcgctcaccgacgagatcgaggccggtttcaccgcggacgccgagcgggcggccgcgcacctgcgcgacgggctgcatcgggacgtcacccccaaccccgacgaccttttcgcgtacgtctatgccacccccaccccgcaactgcgggaacaggccgcgctggtcgccgacgagctcagccgggaaggagccctctgatggccaccgtcgtccacgagaaactgtccatggcccaggccctcaaccaggcgttgcgcgacgcgatggcggacgacccgacggtggtgctgttcggggaggacgtcggtgcgctcggcggggtcttccggatcaccgacgggctgaccgcggagttcggcgacacgcgctgtttcgacacaccgctggccgagtccgggatcgtcgggatggccgtcgggatggcgatgaacggcatgcgcccgatcgtcgagatgcagttcgatgcgttcgcctatccggcgttcgagcagatcgtcagccacgtggcgaagatgcggaaccggacccgcggacgggtgtcgctgcccatggtgatccgggtgccgtacgccggcgggatcggcggggtggagcaccactgcgactcgtcggaggcgtactacgcgcacacgccggggctgaaggtcgtcgcgccggctacgccgggcgacgcgtacgcgctgctgcgggccgccatcgaggatcccgacccggtggtcttcctggaaccgaagaagctctactggagcaaggaggagatcgagttcccggtccgtgcgcccggcatcggcagtgccgtcatccgccgcgcgggcaccgacgcgaccctgatcgcttacggaccctcggtgccggtggcgctggaggccgccgcggccgccgaggtcgagggacgcagtctgcaggtggtcgacctgcggtcgatcgtgccgttcgacgacgccacggtgtgcgccgcggtcgcgtcgaccgggcgggccgtggtggtggccgagtcggccggcttcgccggggtgtccgccgaggtcgtcgcccggatcaccgagcgctgcttcaccagcctggccgcaccgatccgccgggtgaccggcttcgacatcccgtacccgccgccgaagctggagcacttccagctgcccggcgtggaccgggtgctcgacgccgtcgacgacctcaactgggagcagtgatgatctttcgtttgccggacctcggggagggcctgaccgaggcggaggtcgtgcagtggctggtcgccgagggggacacggtcgccgtcgaccaggtggtggccgaggtggagacggccaaatcggtggtggaggtgccgaccccgttcgccgggcgggtcgccacgctgcacgccgcggccggcagcaccctggcggtcggcgagccgctgatcaccgtggaggaggtggccacggcgacggaaacctaccgtgaggaggagcgggccggctcggggaacgtgctgatcggctacgggacgtccggtgccgccacgaccaccacccggcggcgccggccgcgcggcccgatcctgaccaattccggtcacacgcggccgccgcaggtcatctcgccgctggtgcggaacctggcgcggaccaccggggtggaactgggcacggtccagggcaccgggcgcggcggggtgatcacccgggcggacgtggaacgcgcggcggcccgcccggccgtcgcgcccgcggcggcggtgccggccgcggcggagggggtgaaacgcgtacccctcaatggtttccggaaggccgtgacggccgcgctgacccgcagccgcgcggagatcccggaggccacggtgtgggtcgacgtcgatgccacggagctgtggcggctgcgggagagcaaccccggcgggcccggcctgctcgcctatctggcccggttcacggtcgccgcgctgcgcgagttcccggtgctcaacgcccggttcgacgccgagcggcaggagatcgtccagtacgatcggatcgacctgggcatcgccgtgcagggcgagcgcggcctggtcgtgcccgcggtcgccggtgcggagacgatgaccacggcgcggctcggcgacgagatccggcggatcaccgcggatgcccgcaccgggcgggtgagcggcccggacggcaccttcacgttgaacaactacggcagcctcggggtcgacggcagcgcggcgatcatcaaccacccgcaggtggcgatcctggggttcggccggatgatcgatcgagcctgggtggtcgacggcgagctgtgcgttcgtaagatcacccagatgagcttcgtcttcgaccaccgggtgtgcgacggcggcacggcggccggcttcatgcgctcggtggccgatgccatcgagaacccggcttcggtgatcgcccgactgtgatcctgttcaccggcgacgtcggcggcccggcgcaggatgccgcgctcgggccccggctgctccgcgacggcctcggcgacgcgcgggacatcctgcgcgtctactcgccggcgccgaccgcggcgttcagccgccgggacacgctgcggccgggttacgaccgtgcgctgctcgcggtccgcgcatccgatttcgacccagtcgtacgtccccagggcggcagcctcgcggcataccacccgggcagcgtggtgatcgaccacgtgcaccgctcggggccggaggcgcccgccccggccgaacgcttcgagcggtacgcggcgatgcacgcggccctgctggccgggctcggggtcgacgcccggatcgggccggtgcccggcgagtactgtcccggcgagtacagcctgcacgtgggcgcggccaagatcgccggttcggcgcagcgggtcacccgggacggctggctgttcagcaccgtgatccaggtccgcggcgcggatcggctgcggggcgtgctgacacccgcgtaccgccgattgggttatgacttcgatccgggcaccgtgggggcgatcgaggacaccgcgccgggcctgaccgtggaggcggtcacggcggcggtgctggcggcgtacgaggtttgacctctttgacctttttggtgctttcgtcggtgggagtcgacgtactgtgtcgtcgtgcctttgaaagctgaactcaccagcgcagacctcctcgagatccggcagaccgcgctcggcgaggcggacccgctcgggctggccgccgacctggccgaggccgcggagaacgggcggctcgccgatcccgccgacgccggggccgcgctcgtgctcgccgccgagatcgcggagacgcggtcgcggttcgaggccgccctgcgctatgcggagcgggccgtggaaacctacggcgaccggcaggacagcccggccgccggcgcccgtgcggtgcgcgcccggctgctgttccacatcggtcgcggcgacgaggcgatggccgagttggaggcgttgcggccgaccctggagcagtatccggacgcgccggcgtatctgagcgtggccctggagatcggcggccggctacgggtcgccgagcagtggctgagcgaagcggtgcaggcggccctggccgagcgcgggccggagccgtccgggccggacgaggccgggcagttgctgttcctgctgcagcagcgccaccgggtgcggcacgcgctgaacctcccgcacgacgcgcacgacaacctggcgcaacgactggaggacaggctcgccggcgccggcgcgacgaccggggaccagctgctgttcttcccggagagcgagctgggcaaggtgctcgccgagtggccggggctcgcggacgcgtacggcgcggactggaccgcgcaccgggcccggctggaggggctgctggcccggttgtccgccgccggccaggcgaacctggcggcgctgcgcggctcggccgagggcctgcgcaaggcggccggccgcgacggtgatccggccgacgccgaggtccgcgcccggtacgcgcggcagatcgccacgggcagcgggccgatcccgtggcccccggagcgcaacggggcgtgctggtgcggatccggcaccaagtacaagaagtgctgcctgccgcgaggccgcgcctagagcatccacccccgcctgccgcgctcggtacaaccagcacccggacggcgggcggtttcccgcgaactcctcccaacgggtcgccgccggtccaataatccgctggacggatgagtccgggtgaaacgcgatcaacggtctgcggggctgtcatggcgagcggtgtgatcagcaggacagtggtgacggccggggcagtcgtgctgctggcggcgatggtcgccgcgccggccgcggcccggtcgccgggcagccgggtggtacagctcgccgccgggaacggtcacacgtgcgcgttgctcagcgacaccggggcctactgctggggccggggcgccgagggtcagctgggcgacgggagcaccgtgtaccggtcgggcccggtggcgatcgccgcaccgcacggggtgagcttcacccagctcaccgccgggcaggcccacacgtgtggggtgggcagcaacgccaaggcctactgctggggcatgggcgactacggtcagttgggtgacggcgccaccgcgaaccggtcgagcccggtcgcggtcgccggcccggcaggcgtcggtttcaccgagctcgccgccggcgaccgccacacctgtgcgctgggcagcgacaccaggacctactgctgggggatcggcaacgacggccagttgggtgacggcgccaccgcgaaccggtcgagcccggtcgaggtggccaccccgccgggcgtgagcttcaccgagctcgccgccggcgtctaccacacctgtgcgctcgccagcgacaccggaacctattgctggggcatgggcggcatgggtcagctgggcgacggcggcaccgtgaaccggtcgagcccggtggcggtcgccgccccgcccggggtgaccttcacccagcttgccgccggcggcttccacacctgcgggctgggcagcgacaccaggacctactgctggggcctcgacgagaccggccagctgggcgacggcggcaccgcgcggtggtcgcgcccggtggaggtggccgtcccggccggggtgacgttcacccggctcaccgccgggagcaaccacacctgcgcgctgggcagcgacaccaggacctactgctgggggtacgggtactacggccaggtgggcgacggtggcaccgtgaaccggtcgagcccggtggaggtggccgtcccggccggggtgaccctcagccggctcactgccggctggtaccacacgtgcgcgctgggcagcgacagcacggtctactgctggggactcaacgagaccggtcagctcggtgacggcagcatcacggaccggtcgtcgccggtgggcatgccgccgctcccgtcaccggccgggccgctgccgccgaccggcgtgtccgccaccgccggggaccgggagatcgcggtgtcgtggacggtcccggcggatctgggcagcggggcgctgaccggctacaccgcgaccacctcgcccggggggaacagttgcaccagcgtcacgaccgcatgcctgatcaccggtctgaccaacggcaccgcctacaccgtcgccgtgaccgccaccacgaccgtcggcacctcggcggccagcgacccgtccgcgtcggtcacgccggtcgccgggccgctgccaccgaccggcgtgtccgccaccgccgacgaccgggagatcgcggtgtcgtggacggtcccggcggatctgggcagcgggacgctgacccgctacaccgcgaccacctcacccggcgggaacacctgcaccagtggcaccgcgacgacatgcacgatcaccggtttgaccaacggcacggcctacacggtcaccgtgaccgccaccacgaccgtcgggacctccacggccagcggcccgtcggcgccggtcaccccggtcgcgggtccgttgcggccgagcggcgtgtccgccaccgccggcgaccggcagctcgtcgtgtcgtggacggttccggtggatctgggcagcgggaggctgaccggctacatcgcgaccacctcgcccggcgggaagacctgcgccagcgtcaccgcgacgacatgcacgatcaccggtctggtcaacggcacggcctacacggtcaccgtgaccgccaccacgaccgtcggcacctcggcggccagcgatccgtccgcgccggtcacgccggccgccggtccactaccgccgaccggcgtgaccgccaccgccggcgacgggcagctcgtcgtgtcgtggacggctccggtggatctgggcagcgggaggctcaccggctacaccgcgaccacctcgcccggcgggagcacctgcgccagcgtcatcgccacgacatgcacgatcaccggtctggtcaacgacaccgcctacaccgtcgccgtgaccgccaccaccacggtcggcacctcggacgccagcgtcccgtccgcagcggtcacccccgccgccggcccgccggcgccgaccggcgtgaccgccaccgccggcgacaaggcgatcaccgtgtcctggatctcggcggacaccggcgggcagacgccgacgaaatacacggccaccgcctccccgggcggaaagacctgcacgatcagcagcagcagcagccacagcgggctctgcacgatcaacggactgaccaacggcaccgcctacacggtcaccatgaccgccaccaccaaggccggcacctccccgctcagcagcccgtccgcgccggccaccccggctgccgtgccgccggcggaccggccgcagccgccggtggtcaccgccgtgaaaccgcagagcgaggccatcgcggtgtcgtggcagcccggttcgctgggcgccggcacgctgctcggctacaccgcttcggcggccgcgaccaacgacccgtgctcgtccgccagcaccccgtgcatcaccaccagaaccaccgggaagctgggtgccatccacctcaccaccacgacggccgacccgtcgacctgcaccagtaccgacactgacgcccaagcctgcaccatcaccggcctgaccaacggcgtcagctacgccatcacggtggtcgcccacaccaccgccggcgattccggggtggacctcagcgggccggtcgtcaccgtcaccccgggcgaccggaccctggtccacggctcgcgcttcaccacggccgtcacggccaccgatccctcaggcatcggccgttcctacctgaccggcgcggacggggcaggactgcccttctcctaccccagcgccaccgtgccggccggcgcggacggcgaccggaccgtcacctggatcgtgctcgacagcctcggcaaccagagcaccgcctcgagcaccgtgatcgtcgacaacaccgcgcccgcggtgacgttcggcaaggcgccccgcaacggtgccaggatcgccaggaccaccacgatcaccgcggccgccagtgaccgcaacggtatcgcccgggtgcagttgctggtcaacggcaagccggtggccgacgacacccgagctgccttcgccttcgtcctgaacccggcgaagtacgggaggaagttcaccgtgcagatccgcgcctacgaccgggccggcaactcgcgatccaccagccggcgcacctaccaccgctgaaccgcggactcccgaccccgcccagagccaccacgagcgcatggcggcgcggcgcgaccgcggcgaccggacagccactgtgaagcggaacgtccggcccgaaaagccacggacaggtccaggacgtcctgggacgcgaggccgtcgggaaagcgctggtacgaggtcgcgtgccgctcgacacgccagtgtggtctcagtccggatcgtcggtgaggcaggggtcgtcgggatcgatggtgcgcacgatgcggcggccgatgtcgcgcaggtggcgctgctgggcccgggtcagcgggtcgaagatcaggcgctgcacctccgcgacgtggccgggggcggtctcgacgaccttctgccagcccgagtcggtgaggacggccagggtgtaacggccgtcggcggggtccggggtgcgccggacccagccccgtttctccaggcgggtcaccacctgggagaggcggggcagggagccctcgcagaaggccgccagggcgctcatccgcagggtgtgctccggcgccatggacaggccggccagcacctggtactcgaagtgggtgagctgggcgtcgcgctgcaactgcacgtccagtgcggccggcaggcgggccatcaggccgatcagggtcatccacgtccggcgctggtcgtcgtccagccagcgcggctgcgcctcgtcggtcatgaccctcagcatagcctcgatgacttgcagcttgaagtcatgaggtcatactgttgacttaacacatgaagtcatcggagggcgacgtgtctcgtgaggcgaagcttgacccggcgcggccggccgcggcgtacgacgcgctgctggcccgggtgctgccgcaggcccgggcacagcgggtgtgggagccggccgacggggcgctgccggcgctgttcgtgagccacggggcgccaccgacgctcgacgacccgcaatggctcgacgacctgttccggtgggggcagtcgatgccgaaaccgcggggcatcgtgatcgtctcggcgcactgggagaacgcgcccgcggcgctgtccggcagcgcggccggcaccccgctctactacgacttcggcggcttccatccgcgctactacacgctgccgtacgccagtccggacgccaccggcctggcccaccgggtggccgggacactcggtcggaccgggccggtgcaccagttcgtgaaccgcggtctcgaccacggggcgttcatcccgatgatggccatgtacccggcggccgacgttccggtcgtgcagctgtcgatgcccagcctcgacccgcaagcgctgctcggcctcggtcagcggctgcgcgcattgcgggacgagggcattctcgtcatcggctccggattcatgacgcacagtttcgcggtgatgcgcgatcccgcactggtcgggcacacccgggccttcgacgcctgggcggcggacgcgctggcccgcggcgacgtggacgcgctcaccgattaccgggcgaaagcgcccggcgccgacgtcgcccatccgaccgccgaccactatgtgccgctgctgctgaccctgggcgcggcggcggatccggccagcgcggtgtcggccatcgaccggatcgcgttcggcaactcgatccggtcggtcagcgtcgcgtgagtggccggtccgggccgccgatcgtcgtcatcggggccggtcaggccgggctctccgcggcctaccacctgaagcggcgcgggctggaattcgtggtgctcgacgccgcggacgggcccgggggagcgtggcgggaacgctgggaatcgctgcggatggcgaccgtgaacgggatcttcgacctgcccggattcccaagagcgcaaggggatccgcaggagccgagccgcacggcggtgccgcggtacttcgcggacttcgaacgggccaacgggctgcgggtgcggcgtccggtgcgggtgatcgacgtacgggagaagggtcttgatctggtcgtggcaaccgaccgcgggcaatggtcggccgcggcggtcatcaacgcgaccgggacctggaccaatccggtgctgccacactatccggggcaggagaccttcgccgggaggcaactgcacacccgggagtacgtgtcggccgaggagttccgcgggcggcgggtcgccgtggtgggcggcgggatctccgcggtgcagcagctcgaggagatctcccgggtggcggcgacgttctggtacacccggcgcgagccggtcttccggaccgacgccttcacgccggaggtggccggccgggagacgatcgcgaaggtcgtcgccgacgtggaagccggccgaccgaccggcagcgtggtgtcctacaccggactggcctggacgccgtacgcgctggccgcccggcagcgcggcgccctggagcgccggccgatgttcaccgcgatcgagccgcacggtgtccgtgcggccgacggatcgttcaccagcgtcgaggtgatcctgtgggccaccggcttcaaggcggcgctcgcgcacctcgacgggctgcatctgcgcaacgcccgcggcggtatcgcgatggccggtacgcaggtggccggcgagccgcgcgtacacctgatcggtttcggcccgtcgcagtcgaccgtgggcgcgaaccgggccggccgggaggccgctgtcaccctcgcgcgacacctggcggcgagatccgggcattgagatcttggacagcggccgggtgatgtgaaagatttgtcctgcacgtccgacggccacggggaggctgggttcgacatgtcaggtgccgcatcgcgatgggttgccgcgttgacgctcgcttcggtgtcggcgttgctgccgacctcggcgcaggccgcgcccctaccggcagcgtccacctgcgccggtgacaccgggacggccgcggaccgggtcgtcgccgaccggctgcgcccgtcgatgaccggccggcgcctcggcaccgcggtcagcccgcgggccgtcgcctgcgcccgggcgatcatcgggatcgtgcagcagcgcggcctcgggccgcgcgccgcggtgatcgcggtgaccacggcgatcaccgagagcaccctgaccaaccacgtggtgtcgaccgaccacgacagcctcggtctgttcgagcagcggccgtcgcagggctggggccgggccgcgcagctcgtcgacccggtctacgcgaccaacgcgttcctgaccgcgatgctccgcaaattccccggcgacagctggatgggcggcgacatcggcgcaatctgccagcgggtgcagacgtcggcgctgcccggggcgtacgcgttcgaggtccacgacgcgcagctcatcgtctccgcgctgtgggcggtcgccccggatccggcaccggccgtgcccaccgcggcggcgaccgcctccgcctccgccgcggcgtccggtccgttcaccaccgcgctggcctcggcccggccgcagctcggcgcgctgaacggccggcacggcctggcgatggccgactggaacggtgacaagcaccccgacctgatgatcatcaacggggtgggcgccgccaccggcaagaccgaaatccggatcatggacggcgcgacgaacttctcccgcctcctgctgatcaccgcgaccgcgctcggccccaccgacgagcgccacgcgtacgcggtcaccgactacaacggcgacggcaaacccgacctggtcgtcacccagaaatccggcaccgccagcggtcacaccgaggtgcgcgtcgtcgacggcgcctcgaacttccagcgcctgctcgtcgaaacggccaccgtgctcggcccgaccgacgaccgctaccagttctcggtcgccgactggaacgccgacggccaccccgacctgctcgccacccagaccaccggcaccgccagcggcaaggtcgaggtgcaggtcctcgacggcgccacgaacttccagcaggcgtcaccggccgtggtcaccgcacagccggccggtgacggggtccgggtcgcggtgaccgactggaacggcgaccggaagcccgacctggtcaccacggtcaagaccgacctgagcgtgctcgacggggcggccgggttgaccaagaccctcgccacggccaaggtgccgggcgacagccgggagcaggtgctgaccgactggaacgccgacggcaagcaggacctggcggcggtgcagaccgagggcaccgcggagatctccgtcctgggcggctgacccgcgtgcggtttccggacagggccgatgccggtggcgtgcatgagaaagttcgcacgcttcggtctcggcggtgaggtcttcagcgcggacttgccgctcgtcgcactgaccgtcccggcaggggccgcgtccggcgaaatcaagcttctgctcgacgaaggccaggccgatggctggtggcaccacgaggttggttgtggttctcaacggcgctgggacgcgtaacgcggcacctcgtgcgggtcggcggcgcggccggatggctggcaggattgcctcgtgccgtggcccgacagagccgagatcatttcgctgttgcggcggtgtgacgatgccgaccatctggagcatcccgccggcttcgacgatgcggccgaaagacgccgattcgggctgctggtggctggcctcgagcagggtttcggcggtgagtgcgcggtcgacgccggcgcagcggtgcaggacgcgagttacttcggccaggtggtcgtgccgggtccggcgacaacgaccggtgtgccgatcttcattcgggtgagcaacttcggtggtctcgcactggtcggtgccgagggtccgggccgttatgacgacgaggaaacgcttgcgctccttgccgatgcggacctgacgcaagtcttggggattctggccagccaggactacgtgccgctgctggaagacgttctggcggcagagtacgacggcatcagtgacgtgctgagagatgcctatcggtcgtacccgccgacgtggatcaacctgtccaggagacgacgtattggttggtctggtcatcgagtcggatgtcggcggggcggtcggtgaatccgaactcttgggctgcccaaccagcgatggcgagagcgagggccggctcgatgtagtccacttcgatgatctccagtgcgtggatgacgacggtgacgtgggcggtgggttcggcgcgcgtgatgtcgtcggcgacgtggagcagtccggtccgcagccatccgacttcgttctggctcagcctcagtggtgtgccgcggaaaccgtcagtgacgtgggacgtatccagccagatgtgatcgctgatgtgatcggccttcacgggtagggtgctttgcctcaaggcctcggcggtgaggccggcgaagatgccgatcttgttggtttggcgtttgaagcggtagttgtgcacgtgcgcccaggtttccttggagatcttaccgatggtgtcggctcggcggctgacgtcggcggcgtaggtggtccagtcgccggcgctggcgcgttgccaggcggcggcgacgctgatgtggatgcccagcatccgggcgaggatcgcggcggccagttcggtggcgaggtcgaacagtgcggtggagcgggactgtgcggggttgaggcccaggtcgcacaggcgtttggtgagttggaaggcgctgacgggtcggccgggtcggccgccacggcttctttggacgtggttcgcagccggtatccatgcccgcttcgacgacgccgggaaaggatagctccgcgggcggcagtggtgtggaccaggtggtggcgccggtctcggtgtgacgggcgacgcggggagcctgacctggtggaactggacggtaagggctggccggtagccaggtcgtgcggataccgtcggggagcaggacgaaggcgccgaggtgttcatgggcatgatgctccggaacgaccgagcggaggacctgaccatcgaggcccacctcggtgaaggtgtgaccgccggggccgcggtgcgacagccagaccgtgccggccggggtgactcgcggcggtcaggtgggccatcgccccgatcgaagcccggatatcgccggcggggcccatggccgcatcggatctacgagcgggacgaggtcttcttgaggatcaggcggacggcggggaggacctcggagacggccgggatgccggggcccggctcgcgcaggccgatggagagggctggggccgagcgggccagggagccggccatgcggtcgatgtcggtgatgatcgacccggtgaggaccagcacgccggtgtcgtcgagttcggtgcggacggtgcgcagggtctggtggcgggcgtcacgcagcgactcgagcttctcgtggcggcggtcgtcggagcgttcggcgaacgcctcggcggcggcggtcaggaccggggcgatcggggccgggatcaccggggcgtgcggggtggccgcggcgtcgaacatcgagcgggccaccgagttgacctgctgcaccccgtgctccagggcgtgcagggtgtcgcgcagcggggtgaccttggcgaccggggtggtcagcgaccagtgggcgtggcggatcatgtcgtcgaccgcggtggccgcctcgtcgaagtcggcaccgaggtcgcgggaccgggccagccactgctcggcctgctcccgggtgtagccgtcgcgcacgccgtcgccgagggcggcgagcagccgggcaatctcaccggacaggcggtccaggttccacgcggcgcgctccagcggggtcatgccgccgaccagcggggacaggatggcaccgaccacgatgccgagggcggtggcggcgatccgctcccagacgtacgcctcggtgacggcgctgccgccgaccaggatgccgagcgaggtggcgggcaccgtcaccgagctctcgccgaggcgcagcagacgtccggcggccaggccgcagccggtgatcgcggcgatcgtccacggggtgaggccgaagacgccccacacggcgacggtcagaccgagaccggccagggtgccgatcaggcgctgggtgccctcgcggaccgaggcgtgcgagctgagctgcacggacagggtggcggagatggccgcggtgaccgggccggccaggtgcagggtgccggccgcggcccaggcgatgccggcggcgaccgcggtgaccaggccggatcgcagcaccgccgggtcgacatgtcggcggcaccagcgtgcggcgcggcgtacgaggccaggcaggtgcgggatcagggaacggcaggcggactcgaccgcgggccggaggtggcggcggagcagggcggcggtgatcgcacagagcagcaggctcgcggcgacgacgaggatcgggtgcatcggtttcgacgctatccccgcggcgcagccgtttttgcgatttgggcggattgtgacgggcgtcgcccccggtcgtgggaaatcggtttccttcgatggttccagccgatacgaacggtgcgtgccctcgctcgcgctgttcgccgcggttctgctgctcgggatcgccgactcgatggtcacctcgtacatcgtgctgttcggcgcggatgtggtcgggctgacgccgctgcagatcgggatctggtccgctgtgttcgcgctcggcgggatcaccatcgggtcgtggctgggccggttgttcgatcggcggccggccagggcgtacgccgcaatagtgatcttcctgggtgcggcgggttacctggtgctgccgagggtgtccgattttgtggttctcctggtgatggcggcgaccgtgctcggggcgatgggcgccgcctttccgcagctgttcgccctgggcggcgccgggccgcgggtcgcggcggtgctgcgctcggcctggtcgctggcctgggcgacggggccgctgctgggtgcgctggtgctgtcgcacggcggctacacgtggctgatgtggaccgcggccggagtgttcctgatctccgcgctgaccgttttcgccgtgccgccgccgcgtcccgctccggccgcggatccgctgccggcgcccactccgatcctgctgaccgtgggcgtcctgctgttcttcgcggcgatgttcgccggtggcctggtggtgccactgttcgcgacccgcgcgctgggccggtcggccgcctcggtcggcgtgctgttcagcgtctgcgcggcgatcgaggtggcggccacgctcggcttgacgctggtgccggccaccttcagtcagcggaccctgatcctcttcgggttcgccgcgctcgccgcctaccccgtggtcatcgtcgcggcgtccgggatgccgctgctggtggccgcgcagctgctgcgcggggtgggcatcgcggtggtggccgcggccgggatccggtatttccaggagctgctggccccggcgaccgggcgggcgaccacgctgttcgccaatgcgtcgaccgcgggtctgctggtctccggcacgctgtccggcgcgggggtcgagcacctcggataccgggtgacgctgctgctctgcggggcggtgacggtcctgggcgcgatcgccttcgcctttggggcgatgaggtttagaaccggtatatccgggtagcgcttgtccgttatgtcaccgctttcaggaaatatcatgtcgttcgaccatcgcgcgctcttctgcagcgccccggtggccatgctcgtgctcgatcctgaactggtgatcgtcgaagtcaacgacgactatctgagcgccaccatgcgggagcgggcggacctgatcgggcagtcggtcttcgccgccttcccggaaaaccctgccgacccgggagccggctcggtcgcccagctcgcgagctcgctggaccgggtgcgccgcgacggcgtcgccgacatcctgcccatccagcagtacgacatcccgcagcccggcggcggcttccagatccggttctggtcggcggtcaacgcgccggttttcgccgcggacggcacggtctcgctgatcattcaccgggtcaccgacgtcaccgagtacatgctggccaaggaggggcacgccctgcgggtgctgaccggcgaactcgaatccgagatcttcgcccgccggcaggcgcaggagcggatcaccatgatgcaggcggtcgccgacagcctggtcgtcgcgatcatcgccggtgacccgaccgggcgccccgcgatgtgcaaccaggccgccctcggcctggtcggcgacctggtgcgaggccgggcgctggagcagtggccggagccgctgcggccgctgctcgcccgggtgctgcacggcgaggtcgtccgggaggccgaggtggagctgcgcctgcccgggcggccccggcagatcctgcggatgaacgcccgcccgctcaccggccagccgagcctcgccgtggtcgtcgggctccgcgacgtcaccgcccgccggctggcgtcccggctgcaggagggcgagctggagatcacccacctgatcgccaacggacagccgtccaccgggacgttgcggcgggtgatggcgatcgccggcgcctccatcggctggcaggccaccgaattctgggccgtcgacgaggtgacccggacgctgcggcgcgaggcgcactggggagagtcggcgcgctccggcccggacctgccggcccaaaccctgcgcggggccgggccccgatgggaggacggggcgctggccgtcccggttccggccggcgccgaacctctcggggtgctggtctgctacgccggggatgacgacgtaccggaagaattgcgggccgcggtggtgaccggcatcggcgcgcggctgggcgaatggctgcagcggcgtcgcgccgaacggctcgccgccgaactcgcccgcacccgcgacgaatacatcgcgctggtcggccacgaattgcgcaccccgctgaccagcatccaggcgcacaccgaactcctgctcgacgaccccggcctcagcgacgaccagcgggacgcgctgggggtgatgcggcgcaacaccgagagcctacggaccatcgtgctgcgcctgctcgacgtggccgggctgcgctgggggcacatcgagctgcaccgcaagccggtggacctggccgtgctggtgcgggaggcggcggccgggcacagcggggtggcgatcggcgccgtcgacccactgatcgtcgacggggaccggggccggctcggcgaggtgctggacgagctgatcggcaatgctcgggactgggcggctgagggcaccgtggtcacggtgggggtgcacgccgatgggggcgcggcggcggtgaccgtgacgaaccgcgggacgccgatcgcggcgcacgaacgcggccggctgttcgatctgttcttccgcggtgacgcggcgcggcacggcgggatgcggggcaacgggctggggctgaccgtggcccgggcgatcgtggagcagcacggcgggacgctgacggtcggcgagccggacggcgggatgaccaccttcaccgtccggctgccgttgaccgcctaaccgcaggaaaccgcgggccaggtcccgttgccgttggtctggatcgtcagcccgaaggagttgccgctgccgttcggcttggcgaccagcgtttgcgcgttcgggtaactcgcggtcgtgttccaggtggcgatgaccttcgccggggacgggacggtgagcgtcacggtccaggtggtggagccggaaacggtgacgttcaggttgtaccggtcgctccattgctgtcccgcggagagcgaggcggtgcaagctgtgccggtgccgccggtgccgccggtgccgccggtgccgccggtgccgccggtgccgccggtgccggtcggcgcgaccgcccggccgctagctagctagggcgagatcaccccggcgcacaggccccggctcgccaggccctgggcgatccgcggaatggcggccaccgtgttggccggccagtcgtgcatcaggatgatctgcccgttggtgagccgggcattggccgccacgatcgcatcgacgctcgcgccgttccagtcctgcgagtcgacatcccagatgatctcggtcagcccgtacttctgctcgaccgatttcagcgtcgcgttcgtctccccgtagggcggccggaacagcttcggcgtgccaccaccggcattggcgatcgccgattgggtccgggagatctcggcatcgatcgtcgcctgactctgctgggtcagatgcggatgggtgtaactgtggttgcccacctgcatgccggcatcgatctgcgccttgaccagggccgggttggccgcggcatgctggccctcgttgaacatcgtcgcccgcagcccgttggcgcgcagggtggccagcagattctgggtgttcccggcggtcggcccgtcatcgaaggtcagcccgacgtatcccgaacaggtggcggcctgcgcggcggtcacctcgaccgccacgaacccggtggcggcggtcagcacggtggccacggcggcgagcatgatgcgcatggtcagctcccgctgcacgaaacgttgggccacgtccagttcccgttcgcctggatggtgacgccgaaggtgttgccgctgccgttcggcttggcgaccagggtctgcgcgctcgggtaactcgccgcggtgttccaggtggcgatgctcttggccggggacgggatgttcagcgtgaccgtccagttgctggacccggagacggtgacgttgaggttgtagcggtcactccactgctggccggcggagagcgtggcggtgcacccgccgccggtgcttccacccccgccggtgctgccgcccgtgccgcccacggtgatgttcgaattcccgctgctctggtagccctcggttgccaggatctggtagttgaaggtgccgaggttcatgcccttggacgcccaggcgtcgaaatggttgccggtcgtgatggtgccgccggtccgcttcgactgccggacactccaatactggtagaacgtggccgtgccctggatcgacggctggttgacgcgctgcgtgcgatagatgtcgtacgtgccgccgtcgctggtcaccgtgcccatgtaggtgccggtcgggcggtaggtgccccagttgtcgacgatgtagtactcgacgagcgggctggtggtccacccgtacagcgaaagataggcgttgccgctcggattgaacgaccccgagtaggagaccgcgcggcgcgccccggtcgaccagcccttgccggcgacgaagttgttcacgctgctccactgggtgctgtactgaccgccggcgcccatggtcatgctgacgttgccgctgtccttccagaacgagtagtaatagccgttgttggtgccggtctgattgctgctgacggtggtgtcggcgtgcgccgggctgctggccagcatggtgccggcgacggcggcgaccaccgtgcaggcggcggcgagggtggctttgagccgggcccggggacgggatgacgtgggagcgtcgggcatggcgaatccttcgggggagtgggacttccgggatcgacggtgagcgatccctgtctgcgtgagtattcgcgcgcccgctccacagtgtcaacaacttacggaaacactccggtaatttagcagctagatgagctggtaaaacttaaccgttcagtagtttgattgaaaggttccgagttgaagttccgaaagtttcgaagccgcatgtggaggaaggagctgccgggccggtaacatcccgcgccgacgagatcaacaactccggcccccgggccgggtcacccttgaggcgcacatgagcattgccatcccgtccagcctggtgccggacggctccggcgtaccctccgtctgctcccggcacggagaagcccccgccgtgcagaagccggtcaaattctggtccaagccgccggcctgggccctgatcctgatcctcttcggcgcgctgccgtacctcatcgtggtctgggcgctccgcaaagaggtccgctcacaggcctggccgttctgctcggagtgcgtcaagctgcacaagaaccggctgctcatcggcctcggcctgatcgccgtgctcccgatcagcctggcgttcccacgcggcgactcgttcgggacggtggtcctgctggccctcgtcgtcgccctcgccggtgccgccgtcctcgcccgaggctcctaccggatgctgcccggtggcgtggtctcccgcgacggagcacaggtggacttcccgaactcccacccggccttcgacgccgccgcgcaggcggcgtaccaccaggccgcccagcggtacgcggcgtggcaggccgggcagcacgccccgtaccaggcgccgcaggcctgagcccacgaacacgcaacggcgcccgccctcaccgggcgggcgccgttgcgtgtgttgtggacagggatcagaagatggcgttgaaggtgttccagccgatcccgtggctggatccgctgctgtccacgccgggccaccgcggtcgtgcaagcccttctcgtcctgcatcgcgtcgaagccaaccgctacgcaggatgaaaaggctcggtgcagcagagcctgcatatggtgaaggcatggatttcgccggatcggtgcccgcgaactacgatcgctacctggggcctttgctgttccagccgttcgcccgtgacctcgcgtcccggttggccgaccggtctccctcccgggtgctcgagctcgccgccggcacgggcatcgtgacggccgaggtggcgcgggcgttgcctgatgccgtcatcgtggccaccgacctcagccaggccatgctggacgtggcagccgcccgcagggagacggccggggtgcggttcgaggcggtcgacgcccagaatctgccgttcggcgatgacagcttcgacgcggtctgctgccagttcggcgtcatgttcctgccggacaaggcgcgcgcctacgccgaaatgcgccgggttctgcgccccgggggcgggctgctgttcaacgtctgggagcgcatcgaggacagcccgatcgccgccaccgtcgaggccgcgctgcagaactgctttcccgacgatccgccgcagttcctatcgcgggtcccgcacggctatcacgacgcgacggcgatccgcgacgcggtgcgcgcggcggccttcggtgaggtggatgtggtgacggtttcgctgccgagcgtttcgccctccgcgggcgacgcggcgatcggcttctgccagggcacgccgatccgccacgagatcgtcagccgcggtggcgacctggcggcggtcaccgagagcgtgcgtgcagctctgaccgacaagttcggcaccggggaggtgcgcgccgacatggccgctctggtcgtgaccgcctgctgacccgcccgcgcggcgccgcgcggcgcaggagagccgtcacgggtacgcggacgagctggtgctccgcctccgggccggcggctgacatccaccgggccaggccctcagcatcggtcagtcgggtggtggcttcaccgcggatcgtcgcggtgccggctttcaggatgatccgcaggccgaggaaatcatccggtttgtggcgctcctcgatggtgacgcggggcgggccggtcagcgggatcccgtgtgagcgccaagccccgctccggcggacgagcggctacggctggcggtattcgagctcatcgaccgcttgcaggaaatgatcgacagattcccggggcgggaaagggtcgccgattggtgacggcgctggtggttcaggtgccgttgaccaggtcggcgacctcggttcgggaggagacgcccagtttgcgcaggatgttggagacgtggacggcggccgtcttcggggagatgtagaggcggcgggccagctccgtgttggtcaggccgtcgctgatcaggaccgccacctcgcgctcgcgcggggtcagtgccgccggcccggtcaccgcggaagcgtcgaccggtgtcatgccgagccgggcgcggacctcgtccaggcgggtcacccgccagccgtgccagcgggacagggccgtcgccgccgccttggcgtggacctcggcttcggcggggcggccggcggcgagcaggcagcgggccgcgccgacgtggacggtgccgcgggcggccggtcccaggatgtgcgcatcggtgatcgacaggtagccgtccaaggcgagagcgtgccggccgtgtgcctccgccacctgggcgtcgaccagcgtccggtacgcgtcccacacctccgcgtccagcagggtcgccaccatctcgtccagccgctccgccggcaggcccagctccaaggccgccgacaccaggtcgtgcgcctgttcaccactgcgccaggactgtccggccagtgcggcgaacaggtcgttcagggccatcgaagcgcccggcaggtcaccccgtcggcaggccaggttgaaggtcagacccgggatcgccgtcggcaggttgttcggcagctcgcgcaggtcggcgaggatctgctcgacccggtccaggtgcccggcctccagatacaaaccggccaggaacaccgcgtggaagtcggcccagcggccccgccgccgatacccgatgtcctgctcgcggccctcctccagggcggcgatcgcggcgtccaggtcgccggcgcgctgggccaggcgggcgcgcccctggtagtacgtggcgacggccagggactcgaagccggcgcgctcggcgtcgatccgcatccgttccagggtttcggcgtgttcgatcggggaggtgggcgggacgccgacgaccagggcggccagggcgcgggcggccagcacccattcgccggccgcctccaggtcgtcgatcaggccggacagcatggcgcggccctcggtggcggtctgcgggcgttcggtgagggtggagcccttctcgaccagcgccgccaggcgcaccccgggcagctcgaattcgtcggccagggccagcgcacggtcgcaccagagcagggcgtcgtcgagttcgtcgcgcaggtacgccgactgggcgatcgcggtcatcgcccatgcctggtcggcgcccggcgggagctgggcgatcagggttgcgatcgcctcggtgagggtgcgcatctcggcggcgtcgcgggactcccaggcgatccggaccagcagatacagcgactcggcccggtccgagctggtggtggccaggtcacgccatcggcggccgtagcgcagcgcgtcgtcgagcaggccggccagccacgccgcgcgggccgcggaggccagcaggcccggatcgtcgggcacctcgtcgagccccatctcggccagctgcaacgcctgatacgccgagccgatcgacaggtacagcccggcgccgtcgcgggcggcctggaccaggtcgtcgtagcggccggcgccgcgcgcgtggtgggccaccatggccgggtcggagccgccgccgcgcagcagactgtccagggcggcctcgtgcagccggcggcgctggcggctcagcatctggtcggcgatcgcctcgcgcagcagcgcgtgccggaaggcgaactcgtcgtcgcccgactcgaccagcaccccgcgggtcaccaggtcgcgcagcacccggatcagctcgtcctcgtcggccccggtgacgtcggccagcaggtcgaacgggatgcggtggcccagcacggtggccgcctcgacgatccggtgactcaccgggtcgaggtcgtcgacctgacggcgcaacacatcggcgaggctccacggcagcggttgctcgacgaggccctccacgtcgtaccccggcagggctctcaaaagctcctccaggaagaacgggttgccgccggtgcgatggtgcaacgcggtcgcggcgcgcagcggcgccggggccccggtcgcggccgcgagcagggccgcggtctgcgccggggacaaccgatccagccgtacgtgggtcaccgcatgccggcgctccaactgcgccagcaggctcgccacgggctgccggcgggtcacgtcacccggccgatacgtcccgatcagcaaccgcgggccgtgctggtcggcgatccgctcgaacagcgccgcgctctccgagtcggcccagtgcagatcctcgaagacgatcaccgcgggcgagtcgccgatcaggtccgcgacgatcgccaggccggtgtgcagccgttgcaccgggctgcgccgcggatcggcgagcgcggccagctggtcctcgtccacttcgggccggccgtcgatcgcgtcgagcagcacctcgtagggccgggacagggagccgggctcggcctgcccgaccagcaccaccgtctccggtggcagggtggccagcagctcctgcaccagccgggtcttgccgatgccgggctcgccggcgatcaccgcgacggccggttcccgggcggcggcgagctgggccaggcggcgcagctcgcgctcgcgcccgaccatcaccgggctggcaccgccacggaaggttcgcacgccgaaagcgtaccggcgggccgcccgcgcaccgcgccgcgttttcccgccctccgggaccgccgggccgcggccagcagccgctcccggtccgcctcggcgatcagctcgtgccgccgctcccgggccagtcccagcatcatgaacggatggaacaacatggtctgtctccctcgcttgccgacagacccatgctcgccgtccggacgcggtgcccacatcgacagcgggatgcgtatcttcgcagctcaggccgggataggtatacctagaccttggccggaagcacggtcagcgcgtccggcggatacacctcgggcatccggcggcgctgccggaactcgctggtcagcgtccagccgaccagcgggttcgcggccatcgcccggcggatcgcggccagctcgtcgtaagcggccaggatgccggcggactgcggcagggcgaagaagccgaccagggtgcggcagtagtaggcgtacgcggtgatctcccgggccaggcggcgcagcgccgcccggttcgcctcctcacggccccacatgtcgatgcatttcagatcgtccatcgccgcggtgaagtcgccgtcgtcggcgatccggccggcgatcgcacggcaccagagcatcagccgggaggtggccggttcggcgtcgaccttgcggatcgcggcggcgaccgcgtccgccttgccggtcaggtcccgggccaccagccgggcggcgatggcgggcaggtcccggctgcccttctcggagatctccaccatggtgcgggcggcccggatcaggtcgcggggcaggccgccggagaggcagaaggcgagtcccttgaacggaatcgggatctccgtggtgcgccggccgaccaggtccgaactctccttgaaggccaggtaggggatgctggcgatctcgtcgaaggcgctgtcgaacacgtcgcggaacggcaggccgcgccgctcgaacgaggccatcgcgtcctccgacaccgacaccaggaagtggcagccggccaccccgaagatgctcttgatgtcgttgaggaactgctgcgcgcgcgtctcgtcctcgatcttgtcgagctcgtcgatcccgatcaccagggccgggccgccggccggccggggctgcgcggccgccagcttcaggaaccgccgcagcgagtcgacgatctcgggcaggctcagctgttgccggacgaaaccggtcgagcgtttgagtgacgactccagcccggccggcaccaccttgacggcgccggagtattcgccggcgatgctctgctggtattcgatctcgcgcagccgttccagcgccgcgtcccgcagggtgtcctcgggggcgtaaccggagctcggccgcggcgcgcggcgggcggccagatgtgcgccgaggccggtggcgaccagcagcatgatgaccgcgatgatctggctggtgcccagccggtactggctgccgctgaggatcaggatgcccagcccggcggcgccggtgaggccggccagcagcgagccggcccagagcgggcggcgggcggacagccagtggatcgggtccggcggcggccggtgtccgtcgtgcaggccgagggcggcgcggcagatctgcgcgtacaggtgcagcaggaagtcgcggggcgcgtagtcgacgggggcggagaccaggacccggatggtgccggcggattcggcgcggtgctcgcagaacgaggccaggatcgtcgacttgccgacgccgcgcggcccggccaggccgacactgccgccgggcagcatcgtgaggatcttctccagccgctcccgggccctggtgggcacctcgtagatcgggtcgaacgcctggctgagcccatgcggccgggtcacgtagagggtggtgtcgtacgacggcctcgcgtcgttgaccatccggcgcagcagcggcagcaggatccggttgcggagcatctcgcgccactcccgttccgcggtccgccagcggctgtcgacgatctcgaacggtgtcgaggagtaaccgaagagtccggcgagcaggttcagcgtcaggatgacgctgccgggcacggcgagccagagttccggccggacgacgtcgaggcgccggttcgccgtcccggcgccgaggatcaggatggtgccgagagcggtcagcgagatcaggccgatcaggatcgcgccggtgacgaccgggacccggaggtcggccagccgcgcggtcgaccagtgccggtcgacgtgtccccaggattggaaggcgaccagcaggaccgccagcaccaccgtggtgatcatcaccacggtgaccggcaccagcccggactgctggatcgccacggtcttgacctgcatgccggcgaccgcggtcagcccggccgccagcgccgtcgcgaacgcctgggtgacgaacaggcccgggtggcgcacgccgcggaactcggcgatcgaagccgccgccgagccggtgacgagcaccccggccgcccacagcagcacggggtcggcgtagtccaggcgatgctcacccgggccggcgtaggcgaaggcgaggagccacagcgccatgcccagggacaggatgagccggcgcaggccgggggtgaacgcccactcgtaggcgatcagggcgccggcgtcgagccggtcgcggacccgcgcgcggtcgacgagtcggcgatccacgatctgccaggcatcctgcgcgggtgtgccgagggcgtcacgctcgcgcaggcagcggcggcgcaggaagtcggtggagacggtgccgtccgccagcgagccggcgccgagcacctcgtccagttcctgctcgaacacgtcatgccggtagcggtcgcgccgctccggggtcagtttccaccggggaagctcctggacgggggagtccgccggggccgcgaccggccggcggcggcggagctggtcgaacagcatcctgcagaccgtagtggccgatccggggacatgtccgattctggtcccccgaccgggcgtccgctcatcggacggagctgagcgccgtccgagccgcccgggttcggacgatcgcccatccgaccagcgccgcggccatcgcggtcagcaccaggccggcggtcgtcatcgcggtggcgaactgggtcgtctgctgtgcggtccactgcccggcggtgatcgagccggtgaagaccgcggccaggatcgtgccggtgaccgcgatcccggcgcccgaggtcacctcggacgaagtgtcgaccagggcggcgccgatcgtggtgcggttctccgggaggccgcggagcacgttcatcgcggcgaccacgccgaccacccgcaggccggccgagacgagcaccagggcgagcgccacccagaggtagccgaagcggctgaagacgccgaagacggccaggccggcgacgacggcgagcgagctgagccaggcggcgcgctccaggccggcccaggtgacgaacgggttgacgtagacgccgccgccgatcaggacgacgacctgcgggagcatgccgagcgcggcgtgcgccggagaccagccccaggccagctgcagctgcagggtgaccaggtagccgaggccggcgacggccatcccggcggcggccttgtaggccaggccggtggcgaccagcggccgggcgaccagcgccagatcgagcagcgggtgcgcggcggtgtgttcgcgcagtacgaacagcagcgcgccgagcccggcggccgcggtggccgcccagggctgccagccgccggcaccctcgtcgacgaacagggtgggtgcgatgagcgcgaccacgacggtcagcgtgcacaggaccgcgccggccacgtcgaccggggcgcggtgcaggtcggcggggtcgtccgcggcgatgccggtgcgcaccccggcgaaggccagcgccgcgatcgggacgttgatgagcagcagcgtctgccacggggcgacggacagcacgaagccgccggtggtgggtcccaccgccagcccgaccaggccgacagtggagatcagcgtggtggcccggacccgcagatcgtcgcgggcgaacaaccggaaggccagggccatcgaaccgggggtggtcatcgccgccgcgacgcccatcagcgcgcggaccgcgatcagctggccggcggtggtgacgaacgcggtggccaggctggcgacgccgagcaggatcaggccgaccagcatggtgcggcgccggccgaagcggtccgcgaccgcgccgaacagcagcatcaggccgccgaagacgaccgcgtacgcgccggtcacccactgcaggccgatggtggaggcgtgcagctcgcggccgatggtgggcagggcgacgttgaggatcgagttgtcgagcatctcgaacaggaacactgcggacaggccggcgagggctacccaggcggagcggagtgtggtcatcgggacccctttcacggatacgaacaccgttctactccagatcgctgttcgtagcaatacgaacatagttcgtagtaagtcggaacactgttcgtcgttgcgctagactgcgcgcatggcaccgaccccgcaggaacgccgcgccgctcgtcaccagctcggcggagcgccgtccgcccccgccgcccggcgcggtccctccggtggccgcaagaagccgatcaccgtcgacgcgatcatcgacaccgccttcggcatcatcgagaccgagggctacgaggcgctcaccatgcgtcgtctcgcggtcgcgctggagaccgggccgtcctcgctctacgcccacgtggtcaacaaggaggacctcgacgagctgctgatcggccggctctgcgcggagatcgagctgcccgagccggacccggccgggtggcgcgcccagctgatcggcgtctgcacccgtctgcgtgatcagttcctgcgctatccgggcatttcgcgggccgcgttcgccgccgccccgtcgaacctcgacacgctgcgggtcagcgagggcatgctcggcatcgtgctggccggtgggatcgcgccgcaggtcgcggcgtgggcgatcgatgcgctgacgctctacgtcaacgcgtactgcctggaggtgtcggtcgccgagcggcggcgggctccggacggcgactgggtgctcacccgggccgagatgatgcggcggttcgccgcactgccggacggctttccgcacaccaagcggtatgcggccgagctgaccggcgggacggtgcaggaccgcttcgcgttcaccctgaacctgatcatcgacggcattccgggatgaacaggaccgctggtcacttccggtcggttacggctcatcgccgcgattagggggtacgcgtgggcctcccgcgcgccgttccggcagacattcgtcccgcagggtccgcgcgtggcgttcaggaatacccgcgtaccgccgaattaggctttgtgaccatcctcaaccggatgcggctgggcatgcggctggccgccgcgttcgccaccgttgtggtgttgctgctcgtcgtcatggccgcggctctgatcaccgcggcccgccagggcgccgccaccgaccggatcgcccagacgcagaagttcgtcgcgctgatgaaggacgccaagttcgccgccgccgatttcaacggctggcagaccgcgtacgccttcgacgccctgcgcggggtgcccgacgccgccaaggacaccgggtcctcccgcaagtcgttcctcgcctcgctcggcaagttccagagcaccgtgtccgccgccgccgacgccgccaccagcgagcccagccgtaccgaactccggcgggtcagcgctctcgccgacgacttccggaccgccgacacgcagatcgcccagctgtacgaccagggctccaccgccgcgacaaggaccgccaacggcctggtcatcggcaaggagatccagatcttccagcagatcggcgagcacctcgacgcggtcgtcgccacggccggcaccgacttcaccgccgcccagcacagcgccaccgaggcgaagaacatcggcgcgaccgtcatctgggcggccggcgtgaccgccgcgctcatcgccgtcgcgctcgccgtcatcgtcacccgctccgtcaccggtccggtcgaccaggtccgccgccgcctcatgctgctcgccgacggtgacctggccaccccggtcacggtcaccggccgtgacgagatcgccgacatggccggcgccctgcggcagagtgtcaccgccctcggcgacgcgatgcgcaccatcgacacctcggcgacctcgctggccgccgccaccgaacagatgaccaacacgtccgcgcagatcgccgcgtccgccgaggaatccgcggtccaggcgcaggccgtggccgccgccaccgaggaggtgtcccgcaacgtggcgaccgtctcggccggcggcgagcagatgggcgcctcgatccgcgagatcgcccactccaccagcgaggccaccgccgtggtcgccgccgccgtgcaggccgcccaggcggccaacaccacgatcaccacgctcggccagtcgtcccgggaggtcggcgaggtggtccgcaccatcaccgcgatcgccgaacagaccaacctgctggccctcaacgcgaccatcgaggcggcccgggccggcgaactcggcaaaggcttcgccgtcgtcgccggtgaggtcaaggacctggcccaggagaccgcccgggcgaccgaggacatcacccgccgcgtcgaggcgatccgcaccggcaccgacagcgcggtcaccgcgatcggtgagatcgccacggtcatcgcccgcgtcaacgacttccagacgaccatcgcctcggcgctggaggagcagacagccacgacggccgagatgaaccgcagcgtgtccgacaccgcgaccagcaccgaacagatcgcgaccaacgtggcgacggtggcgcaggcggcccagcagacgaccgagggggtggcgcagacccaggaggcgaacgcggagctcgcccggatgtccagcgacctgcgcgtcctggtctcccggttccgctactcctgaccccggccgcgcggacccggattaggcgggcgtccgatccgggggcgatgatggacccgtcgccgcgcagcgtggtgcgggaggagtgtcgattcgtggccgatccgccgttgcccgcgccgctgctggccatgctcgacagcgatccgcaggggtgggtgctggcccgggcggtgcgcgacgagggcgacatcgccgacttcgccatcgtctacatcaacgaggccggctgccgcctggtcggccggccgcgcgcggagctggccgggcaccggtatcgcgagctgtggccggagacggtgcacgacgggaccctgccgttctaccggaaggtggtcgagaccgggacgccggcgacccggacggtgtactacgaccgcccgtcggtcaccgggcacttcgagctgcgcgccgggccgtacggggacggcctgctgatccgcttcgtcgacctgcggcagatgaccgtgtcaccgggcggcatccggctgtacgacatgctcgacacggccttcgacggcttcaccgtcctgcggccggtcaccggccccgacggcccgatcgtcgacttccgctgcgagtacgtcaaccagctcggcgcccggctgaccggacgttccgcggaggacgtgatcgggcacctgctgagcgagatctcgccggagagctgggacgacggcatgttcgagcggtaccgggcggtcgccgacggcggcgagccgtgccggcagcagctgtcctacccggagatcggccaggtgtgggaggtcaagatcggcaggtccgggctcgacgcggtggtcgtgtcgttccgggagatcaccgaacacatcgaccggcagcggcagctcgcggccagtgtgacccgcgccgaacacgccgccgcgcgggcccgtgccctggaaagcgtcaccgaggcgctggtcgcggccagcaccacgacgcaggtgtacgccgcggtcggatcggtgctgcggccctccgccggcgggcagggcctgctcgtcctgctgcggcaggaccggggcctgcggctggcctaccacgcggggtacgagccggacgtcgtcgcgcggctgcgccacctgccgctcgaccacccgtacccggcgaccgccgtcgcccgcaccgggcgttcccgctacctgacctcgccggcccagctgcgcgcggcacagcccgacccggccgtcgccgtcccgccgggggagcggcaggcgtgggcgatgctgccgctgaccgtcgccggcgacgtgctcggcgtcctcgtggtcggctaccgcgacggccgcgacttcgacgacgacacccggtccacgctgaccgccctggccgggctggcggcgcaggccctgcagcgggccatgctcttcgagaccagcatgtcgatcgccgccgagttgcagcacgcgctgctgccggccagcctgcccgtcgtgcccggactgcggcacgcggcccgctacctgccgtggacccgtggtgccgaagtgggcggcgactggtatgacgtcatcgcggtgcgcgacggccggatcgccgtcgtgatcggggacgtggcggggcacaacgtggccgccgcggcggcgatggggcagatccgggacgccctgcgcgcgtacgcggtcgccgggctgtcgccgtcctcggtgatgcggcacacccacgacctgatccagtcactgcacctcgacaccatcgcgacctgctgctacctgcaggtggacgttgccgtgggcacggtcaccgcggtgctcgccgggcatccgtccccggtgttgcgcaccacgaacggtaccggcctggtcaccttgccgatccagccgccgctcggctcgttccggcggatcgcctaccgggacaccagcttcgacctgccgcccggagccactctgctgctctacaccgacggcctggtggaggactcccgccacccgatcgaccgggggctgagccagctgtgcgccgcggtccgggccgcccccggcgacgaccccaccgcgatcatcgaccacgtgctcgccgccggcgtcgggccccggccccggcgtgacgacatcgccgtgctgtgcctgacccgggacgcggaacagcccgaaacccggtgatggccccgccccgggccggccggctccggcgcgggccgacttcttaccaaccggtgacgtcggggccgaacccgcatcgatccgccgcccgtccccgtaacaccgtgcgcccggccgccaccacggccgggcggtccaccggttatcgagggagcacagatgcgaagaaccgacaggcgtccaggatcgccgaaggtgaaggcgatccggctggtcgcggcggcggtgacgctggccgcgagcggaatcctgaccgtcacgttcgtctccggcggtggcaagggcaccgccgacgccgccaccagcctcggtcagtatgtgccgatcgagcaggtgcggccgaatgtcgcccgggtccggacgtcgccgggcggctcggcgggccggttccgggtggactgcggcaccaaccggaaccggaagttcagcccggacaacccggtggcgcagcccgggatccgcaacggcgcggagcatgtccacgacttcgtcggcaacctggcgatcaccgccacctcgtcggacgccgacctggacgcgtccggcacgacctgccgcgacggcgacaagtcggcgtacttctggccggtggtgcgcatcgaccggtcggtgcgcgacggcggcgcggtcgcgcaggccctggccgggacctcgccgacggtggtctgcccgccggtgcgggaccggcttccggcggtcccggccggcgccaaggccgcggtggaccgccagctggccgaactggaccgtctggaggccgacgcgggacggcaggtgctggccggccggggtgtcaacgtcgggctgaacaccaccgtgctgcagtccctgcgggctcgccgcgccgccctgctcaccgggatcggcgacaccatgcgggccgccggggcgcgccggccggacgggatggtgtcgctggccgactgcgacgtcagctacgacggcctgcacgccgcgctgcacggcgaccaccgggccggttcggtggccaccccgacggtgcggtgcccgggggtgcgcgacaagctgcccggcgtgcccgcgaccgcgctcgacgaggtcgaccgcaacctggccgagctggatcggcagatctccgaggcgaaccagcggctggtcggcgatccggccgtcggcgccaccgcggtcctgggtccactgcgggccaagcgggccgcggtcctggaccggatcgccatcgccatcgggcgcaccggcccgcgcccggccggcctggagcagctggccggctgcaccgtcgacgcggccaccggcgggacctcctcgccggcacccggcagcggcgtcccctcggcggcgaccggcagcggcgcgccctcgccggcgcccggcagcagcgccctgcccgacccgcagggcccgaacctcgaactgcccggcaacaccggcggtatcgtccgcccggcgaaggtgctgatcgaataccggggcaacgcgaccgcgaaggtggtgccgatgccgaagttcctgcgcgcgctgaccggggacgccaaacccaccagccgggggccggccaacgcccgggccgcctggacctgctccggattcgccgaccggctcaccgaccggtatccgatctgcccggccggcagccgggtgcagcgcgtccacgacttccccggctgctgggacggcaggaacctggacagcgccaaccaccgcagccacgtcgccttcgccgaccgggccaccggcgcctgcccggccgggttcgtcgcgatcccgcagctgcgcgtcaccatctcctacgacatcccgcgtgacgtgcaggtcaacgggcagtacgcgctggactcgttcccggaggagaaccacaacccgttctccgaccacgacgacttcatcaacgtgaatgccgcccggaccatgcagcgcatcgccacctgcatcaaccgtggccgcaactgcgcctgaccgaggcgaccgggggctcccgggtcgcggccgggccggccgcgacccgggggtacgttctgtccggaaggagttcacctcagcggaaagggtcctccggtgacatcgacccggttgacgatcgacgtgtgggccgacgtgctgtgcccctggtgctacctcggtgagcagcggctgagcgaggcgatcggccagtccccgcacgccgccgagatcgacctgcgggtgcacaccttccagctcgacccggacgcgcccgccgaggtcggcaccaccctggcgtacctggcgaagaagttcgggatgccggagagccaggcccggaccatggaggaggggatggcggagaaggccgccgccgacgggctcacctacgtggtggaccgcccggcgggcagcaccttcgacatgctgcgggtgatccagctcggcaacgcgcacggcgtcggctgggagtacctgcgggcgctgcaggccgaggtcttcggcggcaacttcgacgcctacgagcacgagacgctggtccgtgtcggtgtcgccgtcggcgtgggcgaagcggagatccgcgacgtcctgacgtcggaccggttcgccgaggaggtccgcgccgaccacgacgcggcggtgggtctgggtgcgcgcggcgtgccgttcaccgtactcggcaatcgtctcggtgttcccggagcggtcagcacccggcagtacgccgccgccatcaagcaggcctgggcccaggtcgatgccggctgaggacggtccgctgcggttcgtcctggtggacgacgcggagtactgtgacgcgcagaccggccggtgcgcgccgggcgaggtggtgacacaggtggatctcaacgagttgtcgacctctgtcctgccctacgtgtcggcggtcgccggcgcctacggcagcgcggtgctcgacaaggtgaaggacgcggccgccgaggacggcgccgacgcgaccgtcagctggggccgcaagctgctcagccggctgttcgccggcaagcgtggcgagaaggtgtccgacgcggtccgggagctggccgccgacccggccgacgaggcgtcgctggcgctggtccgcgcgcagatcctgaaggcgctgaccgaggagccgtcgctcgccaccgaagtgcgcgagctactgcaggcggccactccggccggcgaccagtatcaggtgatcatcacccggagccagggcatccagatcggctcccgcaacactcagacgaatacgtacccgccgctcggcgactgaggggtccggcggtcgccccggacaggcataaccggcggcggaccggggcacactgccggcgtggccatcatggtgtgggtggataaggcggactggaactgttgcggcgatccgttccgggtcggctcgcgggtcgactgggagctccggcgtgacatcgacgcgcggtggctgggcgaggtgctcggttccggcgcggcggtcggcgtcgacgcctatcagtatcaccacggcggtcccgacgcggtgatcgagccggccagcgcaacggtgacccggatccaggcggttcatgcccggcccgatccgcggaccggcacggtgccgggctccggggtgctcaccgagctgcccgaggtcacccggggcgtccccgatcgtggtgatctgacgttcgagggcttcctggtgcggctggaggagtaggcggcgagggccggcccggcaccaggccggcggcggccgcggcggccagcgcttcctgtagcaccacccgttccgggcggccttcgcggcgggcgacggcggccacgtcctcgaactccggcatggcctgcacgatcaccccgtcgaggtgaccgatcttgacggcgatctcgccgatccggacgacgtggcgggccagcaccgtgcggtgccggacggattcccggatgcccagcgtgctggtctgttcgaagaggtgtcgccgtagcccggggacctggtccggtgcgcagagcgcggacaggacgtgggccgggcgccccttcttcatcaggatcggggtgagccacgcgtcggccgcgccggcggcgaggagtcgggcgagcacgcccggccacaggcgcgggtcaagatcatcgacgttggcctccaggaggacgatcttctcccggtccgcttccccaagcttgccctctgcccggtccgcttccccaagcttgccctctgcccggtccgcttccccaagcatgccctctgcccggtccgcttcttctcgctgtccgatgatgacgcgtacgacgttggcccgctccgcccgatcccgtccccccgccccggtcccggccgcctcgacccgcatcgacggcaactcctcgcaggtggccgccagcgcgcggagcagcgccatcccggtcggggtggccaactcgccggagccacccgcggacacccgccagcccagcgcgagctgcgccaccgccggcaccggcaccggcagctgcccgtgcgcgccccgcacccaccccgacccgaccgccacctcgccggccgacaccgaggtgaccccgagatcgtcgagcgccgcgcacaccccgaccacgtcggcgaccgagtcgagcgcccccacctcgtggaagtgcacgtcacccgccgggatcccgtggacccgcgcctccgcctcggcgagccgggcgaacaccgcgaccgcccggtcccgcacggcgaccaccagcccggagtcgtcgagcatgccgcgcagcccggcccacgtgcggtgcggtggctcggcgaccagcacctcgacgtgcgccttgaccgcccgcagcccggcccgggtcacctccgacgcgctgatgcgcaccgagccgggaacgaccgcgtcgaccgccgcctgcaccaccgccgggtcggcgccggcgtcgagcagcgccccgagcagcatgtccccggccaccccggcggacgcgtcgacccaggcgtgccgcgcgctcacgcgcccggctccgcggcgatccgcgctcgcggccggctccgggaccccggctccgcggcgatccgcgcgtgccgccggctggcgatccgcgcgtgcctccagctcatgcggccggctccgcggcgatctgcgcggcgaggtggcccgccccgtacccgttgtcgatgttgaccaccgcgacccccggcgcgcaggcgttcagcatggccagcagcggcgccagcccgccgaacgcggcgccgtaccctaccgaggtcggcagcccgatcaccggcgccgcgatcaggccggcgaccacgctgggcagcgcgccgtccatcccggcggccaccaccacgacccgggcgcggcgcagcagctcgagacggccgaggacccggtgcaggccggccaccccgacgtccaccaccagttcggtggcccggccgagatggcgggcggtcagctccgcctcgcgcgccgcccgcagatccgaggtgcccgcggccatcacgaccaccagcccgccggtcggcgccgcggggtccggtggccaggccagcaggcccgcgtcagggtagtgccgggcatccgggagctcgcccagcaccgccgccgcgtgcgccggctcggcccgggtgaacagggtggtcacctccggtcgcgagcggaccgccgcggcgatcccggcgacctgggccgatgtcttcccggcacagaacaccgcctccgggtagccgcgccgggccgcccggtccaggtcgaggtcggcatagtcgagcggctcagtcacgacccacccgtaccaccgtttcgtcccgctcggcgtcgtccatgcacccgttctacaccgtgtccgatcccgcggaagcggcgagcccgggccggtggaagtgggatgttccacaatgcggcgacctctgtcgatgcgccttgcctattgatccaccgtcggtaatatcggtgcgtttgatcaacaacgggggaggaaacaccacatgcgatcgaaattgtcggccggcgccgtggtggcgctggccttcctgattccggcggcaccggcggtggcgcacaccggcgcgcccgccggcaccaagaccaaccggtcggccgagcgcaaggtctaccgggacctccgcgaaatcgtcaccatcgatccggacaccgccacctccacgcaggtgcggctcgtggccaaccggatcctgttcgagtcgacgagggaggcgctgccggtcctgcccgacgcggtgcaggcagcgatggacggcaccgaggcgcagttgcggaccttcctgaagacgggcctgccgaacgcctgggcgacggcgctgcggatctcggtggtgcggacgctcaccgacgccggcccccacgtctatgcggccgcgcagcagacgctcgacaccgcgaagatcgacgcctacctgacgttcctcaacgtcgacctctacaccgcccgtgagctggacctgcgcgttccgccgcggcacgtcccgcagcggcaggtctgacaccgggccgtcccggcccggtgttccgccgggccgggtcagccgccggtcaccagcatgatgcccagaccggccgcgacgccggcgtggcgggcggcggcgagccgcatgatctgatggcccgatgaacgcatccggtccggcggcccggcaggccgagctgcgactgcgggtcgccgagcatctggagcccggcgagacgctgcacgccgcgctgtggatcgcccgcgacccgggcctgccgctgatctcccggctggcgccgggcatgccgggcagcccgccgccgggaccggccggtggcatcgccgccgagctgtaccgccacctgccggagcacaccgtcgccgccaccctggcgctgaccggcgaccggctgcgcctgctgctgctcgacggcgagttccggccgccccgacgccgccttttcgggcggtccgagccggcgccgctgccaccgctggcgccggtctgggagtgcccgcgggccggcctggccaccgcggccgccgacgagccggcgggcagcctcaccctgcgtttcgccgacgggtcggcgctggcggtggccgccccggggttcaccgccgtcgcgttcgccgaggcggccggtcggtcgggtgccggcggttgaccgtctgagcccggtgacccggaagttgagcgtgccggcggttgaccgtcagagcccggtgacccggaagttcagcgtgccggtgtagacgccggcccgctgctggaagtccaccttcaggcggttggtgatctgcaccgtgtcgccgccgatcgcggtcggcctgccggcggtgaccgccacctccccggcggaggtgtagccggcgtagcttccggcggttccggcgaaggtgccggcgccgctgaccgagaccgcgtagccgaaccgcccggcgccgaatccgccgccggtcaccgggctggcgagcccgccggagaccggggtgagcgcaccgtacgtgccgctcatcggggtgccggcgaccttcagcgtgtagccgttggtcgcgttggacttcacggtcagcgcggcggtgacactgttgtcgccctgggtgatcggatcgacgtagagcaccacctgggcaggggcggtgaccgtcgtggccgggttgggcacgacgagcaccggcgtcgccgtcgtgaacgtcacggccccggactgggacacgtcgatggtggcggcgccggccgcgcgcgtggtgatggtggtgccgtagccgccggcggtgccggtgttggtgaagccggcgaccgacaggtacatgtgccggccgaccggcacggtcaccggcgaggccagggtgtacgtcagggtcgtgccgctgagcgagacggtcccggtgccgggcaggtggacggcgctcaccacgtacaggccggcgccggtggtggcggtgggcagtgcgacggtgatgctggcgatcggggtggcggtgcgggagacgaattcccagccgtagacggcgccggtcgcgccgagggtggcgttcgacgtccagaagatggccgccgaggtctgcagcgtgagctgccggacgcgcagctcaccgctggacgggaagtacagggtgccggtggcgtcgatggccatccgcccgggggtgtgcacccgggcggcgttcgcggtgccggagccgccgtcgccggcccacgagtagctctggtacttgccggcgatggtgtggatgacgccgtgcctgtcgacccggcgcaggacgctgccgccgtatcccgcggcggccgggttgccgtcggcgatgtacaggttgccggcggtgtcggattcgagcccgtcgggctggtccagcagcgcagcggtggccagggcgccgtcgccggcgtagcctagcgcgccggtgccggccaccgtgctgatcgtcccgttgctgatcttgcggaccaggtggttgccggtgtccgcgacgtagatgtcaccggacgcgtcgaccttcacgtcccgcggcgcgttcagtttcgcgagcgaggcggcggtgccgtccggcgaggtgccggccgtgccggtgccggcgatgacgctgaccgcggcgccgttgatcatcaggatccggttgttgcccgtgtccgcgacgtacaccatcccgttcgcagtgtcgatcccgtacggcgagctcagcaacgtggtggccgcgacgccggtcatcagcgacccggccacgccggtgcccgcgacggtggtgatcacaccgccggccaccctgcggatccggtggtggccggtgtcggcgatgtagaggaccccgccggagtccaccgtgacgtcctccgggtcggagagattgccgctggtcgcgagcccgccgtcggccggtgtgccgccagccacgccggtgcccgcgacggtggtgatgatgccggcggccacctggcggaccacgttgttgcccgagtcggcgatgtacatcgtgccggccggatcgacggccaccccgcccgggtggtagagctcggccgcggtggccgcaccgccgtcgccaccgcgcgcccaccacccgttgccgccgaccgtcgagatcgcgccgcccacggtgaagctgcgcacccccagttctgtttgccggcgtcgctggcctggtcgccgccctgggcgacgtagaaccggccggtcgagtcctcgaccaggtcggtgggatggtccagggtggccgcggtcgccgccgccccgtcaccgctcatccccgcgacgccggtgccggccaccgtggtgatggtgccgccgacggtgaattgacggacccggttgttcccggcgtccgccacgtagatgacgttggatgcgtcgacgaccagaccgcgcgggcagttgagtccgctggcggtcgccgccaccccgtccaccgccgcgccggacacgttggtgccgagcccggcgaccacggtccgagagccgcccgccgcggtgtaccggtagacgacgtgattctggcagtcgctgacgtagacgttgccggagctgtcgaaggcgatgttgctgggtcggttcaggccggtggcgaacgcggcgagcgggccgcccgacgtcgacttgagcacctggccgttgtaggtgtcggcgacgaactcgtcaccggcggcgttgaacgccacgccctgcgggttgttcagcccggagaactgggtgcggataatgccatcgctgagggtgaccttccggatgcgcgcgttcagctgcgcggcgatgacgacgtcgttgttggcgtccagcgccacgtcggccggggtgttgatcccggcggccgtggccggaccgttgtcgccgctgttgttgttcgcgcccatgccggcgaagaccgtggcgatcccggtggtcagattgatggcgcgtaccgcgtgggcgaacaggtcggcgacgtacaggatcgacggcgcggccgtggacgactcgtagagggccaggccccgcgcgccgatcgcgatcgaggtggccggctgcccgttgccaccgaccccgccggcggtcgtggccagatcgccggccgccgcccgggccggcgtcaccgggaacgccagctggctggtgacgaccgcgagcaggcaggcgagcgcggccgtgccccggctcaaccggcgcatgcgggcttcccggaccgcccgcggcggtgcacgccacgggcggcgatccgacgccggcgacgccagtagaggtagcccgtgagcaggacgacgagcaggcacagcgcgatgatggtcggccacgggacgatcaggatggcctgaccggtgccctgcgcggtctgcagcaggccgccgccgctgccgtacagcacctgtccctgcggccgggcgatcaggaacagcccgtgcgccacgtaccggtaggtcagcgtccggctggtgccggacgggaacagctgcaggtcgtcggagccgcggtagacgccgatgttcgtgtcgctcagcgtggagtcgaccttcacctggccgcggcccagcgccgcggccgccccgacgttgcgcacccgatacgtgctctccatggtcgcgcccaggtggatgaacccggtgtgggccacctcgaccgccatctcccgctgccgcggcccgggcagttcgaccgtgaccagggcgccgatctggtggtagacgcggatgccggtcgcgccggcgccaggctgcgcctcgaccacgaagcccagcagatagatgtcgggcagcaggccgccgggaacggtcagcgtgaccggaacccgccggtaggcgccggggcccagggtgagcgtcgggggaaacgtcgccttcgccgaccacgctggatccggccggtcggtgaaccgggcctgcccgtcgtcgcccggcaccactccgaccgtgcggatcttgacgtcgaggtcgtgatccgcccggttggcgatggagagttcggtgcggatccggccctgggcgtccggcgccagccgctgtgccggggtgctcaccgcgaagtcggcggtgccggcggacggcatcggtgcggcgagcgcggcggccggcaccgcgaacgctgcgaacgccgtggtcaccacggtcgccaccagggtaccgaacctgcccaccggtgcctccttcgtcggtcgtcgcgtcagtacgagggggtgacggagtacgtgatgctcgcgccgtacgtgtcggccttcagcaggtagtcgatcttcgcctggttggtcagcgtcacggtgtccccgttggtgggtccgaacgcggcgaacggcaccgcatagccggccgtggtgtatcccgcgtagccaccgcccatcgagccctggacggtgcccacgccggtgtgggcgctgaccgtgtacccgaaggtgtcggtgccggccgtcaccgggctgccgacgctgccggcgaccgccgggagggtggcgccgcgcgcctggcccagcggctgctggctgatcctggtgccgagggtgtacccgttcgcggcgttcgtcgccacggtcagcaccacatccttggtctgcgtcgccaggctcggcacggacggatccatcagcatggtgaagccggtggtgttgctgctgaacgccgtcgactgggccaccaccacggtcaccgcggtgctggtgtcgttgaaggtgaccgtgttgccggtcgccgtgtcgatggtcggcgccgcggtgtcctgggtgctgatcacgctgctgtacgcacccgccgtcgaggtgttggtgaagccgctgagcgagatcagcaccccggtcccggcgctcacgctcgcggcgctggtcacgacgaaatccacggtgctgccggtcagcgtggcggtgccggtggtcagcccgtacaggtcggagacggtgatcgagccgggcaccccggtgcccgtcggcacggtgaggaacacgtgcttgatcgtgccggtcgtcgcggtggtgaacgtccaggtgtagcgcacaccggtggcgcctggctggggttgcgaggtggaccagcccacgccggtgagcgtgccggccgcgtacgccgggactgccataccggcgaccgctgcggcggtcacgacggcgaccgtcgccagccgccggctcgtgctgaatgacatggggcctccgaggccgaggggatgactcccctccttcggccccggcggccaccggttgagccttcccgcggattcggtcagccggccaggccccggcggagtcggcggggcagggggctgcccggtaggttcgcggcggccacgggtgtgtgcacggccggtcggccgtgcacccgagccggcgcgctcagcagggggagaggctgaagttgaacagggtgtcgacgtcgccctcggtggtgttcatcgacatcgtgctggtgccggtggaggagccggcgttgagtcgcagttcggtgttgacgttcaggacgctctgcgacccgcaggcggcgtaggtcagcaccggcgccacgtcccaggtcgtccagaggccggaataggggccgctgaacgtcacgtccttgcgcgcggtcgccgaggatccctgccagtagtagctggtgcgctgcagggcggtcgccccggaccgcaggctcgcccggccgcggtagttggccgaggcgatggcgacggtccagccgtccgggatgctcacgaggacgccgagctggcagttcttgcggcggtccacgacgtcggcgtccccgccggccgtggcgacgaagtcgcggtaccggacccggaaaccggtgtcgtcgccgttgctgaccaccgaggcggtgcccggggcgcacccggatccgctggcggcgatcacctcgacggtgatcgcggcggccgccgcgccggcatcggtggcggcatgcgccggggtgccgaacgggagggtgagggtcgtgatcactgcggctaccagtgcgcggttgcggtttctcatggaggtccttccgaggctggggctgaggatgagccgagcgcggatttatcaggtgccaccgtattgactcttgaatgattccagaacggccgctgtcatatccgcgacaaccgtagtggcgctcctgaggcatgcacaagcgtcacctcgacattgaccttcgtctaactcaaaagcgctgcggcagacctctcgcgagtccgggtggcggtcggacaaatactggtaaacctacaaaagaagccgatgatatgcgggttattgcggcattcatgcccggtcgttctctttctcgatgggtatcaagaatgcccgcgatccgcctcgccgctgttgacttgcattgagtgtcatcaatagcttgtcctcggcccgacctcgatcccgaagggataaaaatgaaattcctgttaacccgcggatgcgttgcgctcgcggtgctggcgtcgtcgttgttcctggtgtcgccggcttccgcggcgatcgtcttcaccgatccgccgccccccgacgcgatctccatccagctggtcgccatggcgggctcggggtgtgccccgggcaccgccgacgtggcgatctcgccggacaactccgcgttcaccgcgatctacagcgcctacctggcgcaggcggggccaggcgtcccggtcaccgagaaccggaagaactgccagctcaacgtgctggtcaacgcgccgtccggctacacgttcgcgatcgccaaggtggactaccgcggttacggattcctgcagcgcggcgcggtcgcccagcagcgggcgaactactacttccagggcatgtcgatgggcagctacgccaaccacccgatcgccgcgccgctggacgacaactggatcgccaccgacgaggtgccgatcgcggcccaggtcttccgcccctgcggcgagcagcgcaatctcaacatcaacaccgagttgcgggtcaccaagggcacctcgaccgacgtcagctacgtgaccatggactccaccgacggcagcatcgagacgatctaccacttcacctggatgcgctgccactgaacaggtcgccgagacgtcgagccgctcaggccccggcctggcgttcgacgtctcggccccgagggttcagcgcaggatgccggtgtggccgagggagtagcggcccggttgcggccagacgcagaggccgtgcggttccgcaccgacacggatccgggccagcagccggcctgagccggtgtcgatggcgtagacctcgcggttgtagcggccggacagccagagcacccgcccgtcggcggagacgccgcccatgtcgggactggcctggccgggcagtttccacttgctgaccagacgaccggtgtggaagtcgagcaccgagatgctgccttcgccgcggttggcgatgtagaggtggcgggagtcgcggctggggtagaggccgtgggcgccatacccggtgggcaggaaggagcggacggtcaggtggtcaccgtcgaggatccagaggccgctggtctgcatgtcggccacgtaccacgtgcggccgtccggcgagatcttgatgtcctgcggcatggcgtgcccgggcagctgcagccggccgaccacgcgctgggcggccgtgtcgactttgaccagctcaccggagaactcgcaggtggcgatgaagtagcgaccgtcggcggagaagtcggcgtggttgacaccgcgacacccgatcggcaggacgtgtcgtgcggccatcgtgtgcgggtcactgaagatgatcgccttccgcgtttcggccatcaccatggcgaacttgccgtccggggtgaaatagaggttgtacggatcgtcgacccggatcggcttcccgaacctcccggtcgccgcgtcgatcggcgtcagcgtgctgccggcgttgttgttgacccacagggtgcgcagatcccagctcgggaccacatgctgcggaccgtgcccgacaggcacggttctgatcacgcggtacgtccgcgggtcgatcaccatcaccgtgtcgctccccagattgggcacgtagaccagcgccgggtcgtgcaccgcgaccgccgcgacgtgtccgggccggtcggcggcgtagacgtccgacgggtcgagcggcggtggcatgccgggcaggatcggcccggccgccgccggggactgcggcaacagcgacggcgacggcgacggcgtggccggcggtgcggggcgctgcgcgtccgccgccgggctgcaggcggcgagcgggccggtcgcgagcagggccacggtggcccaggcggccgtccggcgagattcgcgccgacccgggcagccgggtgcggagcgggtcaggtgatcgcggcggccggtcatcccagcaggtccgcaacggtgaccgggcgcaggccgcgtgccttcaagccggcgagcagcggggcgattgccgcgatcgtctgctcgtggccgaaatgcaggctcacgatcgatcccttctgtacggcggccagcgtgttcgcgacgatggcgggcgtgccgggatcggtgtagtcgcgggagtccacgtcgtacgacaggcaggtggggtagccggcgcggcgggccgccgctttgatcgtcggggtggcgaaccgggtctgcgacggacggaaccagcggccggccgaccccgagacggcgcggatcacccgggcgcaggtggcgatctcggcgtacgccgtcgccgacgtgaagcttttgatgtccgcgtggtgctgggtgtggttgcccagttcgtgaccctcggcgaggatccggcggccgagggcgcgctgggtgtcgagccaggcgccgacggccaggacggtgaccggggcggcgccgcggcgcagctggtcgagaagcgcggtgacctggcgtgggtcgccctgaccgtggaaggtcagggcgacgccggaccggtcccgcgggccgtgctgcacctcatccgggaggtccgccccgggtttcccggacggcgcggtggccggccgctgcggggatccttcggcggcgggtggtgcgacgtgcgccggttcggtggcgtcgcacccggcgaccgcgctgagagtgagcgcggcagccgcgcgcaaagcatgacgacgttgcatgcaccggacagtaggcgggaccggatgagagaaccctgaaactttccaccgcggagggaccccccacggatgggggacacccatgaggaggagcggtcctcgagcggaagctcgcgggtgagcacgcagagtgatcagtggggtgctcaacgcgtacaccagggaagatgtttttttcttcgcgacgcaggcaaccttttccgctccgcggaccactcagcggtgatccttccgcacaacctcaggtggttccatgccgatctcccgactcaccccggggctgcaccgtcgtcccacgcgtcgccgtgccgtgctggccggcggccttgccgcggtagccgcggtagccggtatcggactgctcggcggacagccgttcgcctctgccgaggccaacatcagcttcgacaacggctcgggcatgagcttcgtggtggacgccaggaacggcaacctgacgtcgctgcagcacaacggcaccgaactgaccgcaccgggccgggccgccgggcagatcgagtcggggtggaagtcggctgccgtcagcagcaggaccttcgccgacaggtcgatcctcgtcacggtcgacgagcgcgaggtcggcgagacgcagtattactacgcccgccggggcgacaacacgatctacatggccaccgacatccgccagccgcagaaccccggcgaggctcgattcatcacccgcctcaaccgttcgctgctgaccacctcgccggtggccgcccggacggccggcacggtggcggcggtggagggctcggacgtcttcaagttcgccgacgggcggaccgcctccaagttctacagctcccagcggctgatcacgcagcagccgttcggcgccagcggacacggccacggcgcctacctcgtcccgggcaccggcgagatgagttccggcgggccgttcttccgcgacatcgaggtcaacgacaccggcgacgcggtcaacatcacctactgcatgaacagcggccacacccagaccgagccgctgcggctcggcctgcagggcccgtacgccctggccctcaccgacggccccgccccggcgcggcacagcctcgacttcctgtccgcctacattcccgggctgctctccaacgcccagcgaggcggcgtgcaggggacggccaccggatcctggaacggccagcgagccaccgtcgcgcttgccggtccgaacgggcagtactggagtcaggtcaaggccggccggttcctgatcggccacatccgccccggcacctacacggccagcctgtacgcgggtgaactcgccgtgggcgtcgccaaggaggtcaccgtcaccgccggcgcgaccaccacggtggcgctgagcggcaacgtgccggccgccggcacgctgttccagctgggcgccttcgacggcaccccggccggtttccgcaacgccgacaagatcgagacgatgcacccgtcggacccgcggatggccccctggaacgtgggcacgttcgacatcgcctcgggcgccgcgaacttcccgatggccgaattccaggcggtcaacgcgcccctggcgatcaggttcccgttgcgcgccgtccccgccaagggtgtgcgcctgcgggtcgcgaccacgctgaacttcgccggcggccgtcccgccgtcgcgatcggcagctaccgatcgccggtctccgcctccccggcgccccgtgacctgaagtctcgcggcgtcacccgcggaacctggcggggcgtgaacaccacctacgtgttcgacatcccggcggcggccctgaaggagggtgccaacaccctgtccctctcggtggtcagcggcagcaccggaaccaccttcctcagcccgaacttcgtcttcgacgccctcgccctcgacccggcgtaagccggctcaccgggtcgccgcccgccgacgagccgtatcggcctcggcgagcgacggcccgggtccggggcagggcgctggtgccgtcggccaggggcgtgccgcggggtgaacaccctgacgccggcgtcctgccgcgatcgggccgggtgccggcgggatcggtgcgcgctacggcagggtggccaggtcttcgggggtcagctccagggtgtccgcggccgcggagtcggtgatcgtctccgggcggctggcgccggggatcgggatcgacaccggggacttggccaggtgccaggccaggcagacccgctgcgggctcaccccgtgcttctccgcgacccgggcgaaggcgccgccgagcgagccggccgcccggatgccgcccagcggtgaccagggcaggaaggcgatgcccagctcggtgcacagctccagctccggcccggacgagcggaactcgggcgagaactggttctgcaccgacaccagccggccaccgaggatgtcgcgtgcctcgcggatctgcttcgggtcggcgttcgagatgccggccatccggatctttccggcgtccaacaggtcgcggatcgcgccgatcgagtccgcgtacggcgtcttcgggtccggccggtggaactggtacaggccgatcgcgtcgacaccgagacgcttgagtgactcctcgcaggcccgcttcaggtagtccggcgatccgtcgacggtccaactgccgtcacccgggcgccgatgtccgcccttggtcgcgaccaggaccccggaggtgtccccgccgtaggcggccagggcccgggcgatcagcgactcgttgtgcccgacctcgtccgcgccgatgtggtaggcgtccgcggtgtcgatcagggtgatcccggcgtccagagcggcgtggatcgtccggatcgatcggtcctcgtccgggcggccctcgatcgacatcggcatgccgccgagaccgatcgcgctgacccgcacgtcaccgagggaacgagtttgcatggtgcgcttcctctcgcagatgtatgcctctgcgtccctatatgccccgtcgcgcgccgtccaacatcgtcggaccggttccgctcatcaccccgcctgcggtaccggctcctggcgtggtgagaaagcggtgccgggcatcggccgggcgaagtggtacccctggccgcgctcgcagccgaggccgaccagcagcccggcctggaaggcggtctcgacaccctcggcgaccgtggtgagctccagaccgcgggccaggtccacgacggcccgcaccagcgcggtccggcgggtgtcggtgtcgtcggagggcatcagcgatcggtcgatcttgagaacatcgatgggcaggtcgcgcaggtacgccagcgacgagtaaccggtcccgaagtcgtcgatcgcgatgcgcaccccgtcaccgcgcagcgcgtccaggtgggccagtgcctggctcttctgggtgcccccgccgaccaggatgccttcggtgatctccagggtgagcgcacccgcgggcaggccggtctcggccagacatcgtctgaccttggcggtgaactcggggtcgtgcagttgccggggcgacacgttgacggcgatggtgatgccgtcgcgccggtgccagtcgaccgcgtcggcgcaggcgcgacgcagcacccactcgccgagcggcacgatcagcccgctgtcctcggccgcggggatgaacaggtccgggccgatcgggtcctcgcccggtggcaaccagcgcaccagggcctccgcggccaccgtgcgagagctgagcaggtcgacgatcggctggtagaacacggctagctcgtcgtttcgcagagcgccgcgcagccgttccacggtgcgcagccgctcggtctgccggtcgcgcaggccggcgtcgtaccagaccgcgcagtccttgccggccgccttcgcggcgtacagcgcgaggtcggcgtcgtccagcaggtgcgccggatcggccgtcggctcgggcagccgcaccccgatgctcgccgtcacgtacagcacgtggccgtggatcgtgaccggttcccgcagcgtcgcgagcagggcttcggcgcgcgccgtgaccgtcgccggcgcggcgccgggtaccagcaccgcgaactcgtcgccgccggtgcgcgccagcacgtcggcgtcggcgagcccggcacccagccggtcggcgatcacgcgcaggaggtcgtcgccggccgagtgcccgagccggtcgttgacgttctggaagccgtccaggtcgagcaggagcagaccgtacggcgtaccggacgtgatcaggttctgcagcctacggcggttcggcaggccggtgagcgcgtcgtgctcgttcacgtgccgcagcgaccgctgcagcgcggcctgctcggcgagcgcggtgcccagcttctcggcatgccgctgcagctgccgctgcccgttgcccatccggaccacgagcagcagcgagatgacgacggtggcggcgaccggcacgatgaagtcgtaaacggtcaggtggccttcccgggagtccaggatcagggcgtatccggtcgcggccgggccgatcagcaccagtaccgcctgcagcgcggtggcgtgccagccgccggcccgcacgctgatgctcgccccacggccggacaccgccggatgcagcgccgccacgcccggcagcgcgaaggcggccagccagcagagcgagctgcacggcgaacccgaccaggcgccaccgacaaccaccgacacgacgtacgaggcgtccgcgacgatcatcagcagcgtcatcgccaccagcgccacgtgcgccggccgcagccggcgcgccgcgacgagcaggcgtacggcgacggccaccagcaggacgtcgaggatggggtaggcgaaggcgttggcgctgacgaccgcttccggccggtccagcacgtacgggtcgtagacgaagagccatcccagggtggcgctggtgcacgcggcgatgcccgcctcggaaaccccgatccaccgggagccttccggcgagcgctccggaagcgccgccagaccggccgcgagcagcggatacatcgcgaaatagagcacatcgaccacagagaagcgcggtggagccgaccgcaggctgagctcgacggcccagatcgcgttcgctgcgcccccgcagctcagccccgcggccagcagcagccaggcgcgcgggcgcgcggcccggcgcagccggatgccggcgaggacgcacatcgccgaaccgagaccgaccccggcgtaggcgaattcccgaccggcctcgcccaggggcgggctgagcagcatgatgcaggccacgactcccagccagccacaccacgcgtacgcccgcagaccgcgcacgtctccgctcccgccctcgctccgtcacctgacctggcaatgatcggcatcggtcggggccacctgagtgcagcgaaggccaccatcggcgcgagccaccagcggtcgggagatcgggaccacgcaccgaccggaggtccgggccggcgacgctgccgtcaggcgccctgtgcctcgatcgagaccggctgccaccgctgccattcggcgagccgggactcgtagtcggcggtcgcgatggccagcgccgcgttgccgaagaagacgcgcagcggcgggttctcggcgtcgaccaccttgaggatcgccgaccgggtggcctccgggtcgcccgggttgccggcccgacccctgcgcgcctcggcggcctgcgcgcggacactctcgtactccggtagtgcggtggcgtgccgggcggaggagccgccccagtcggtgccgaacgcgcccggctcgaccagggtcaccttgatcccgaaggcggcgacctcctgcgcgagcgcctggctgaagccttcgagcgcccatttggaggcgttgtagatgccgatgttggggaacgcggagatgccgccgatcgacgacacctggatgatgttgccgccgccggccgcccgcagatacggcagagcaccctgggtgatccacagcgcgccgaagacgttggtctcgaactgcgcgcgggcctcctgctcgctgatctcctcgatcatgccgaactggccgtacccggcgttgttgacgatcacgtcgagccggccgaagtgcccggcggcccgggccagcgcggcgagggcggcctcgcggtcggtgacgtcgagcgccagcggcaggatccggtcgccgtacccggcggcgaggtcgtcgagcgacgacacgtcccgggcggtcgcggcgacccggtcaccgcggtcgagggcggcttcggcccactcccggccgaagccgcgggaggtgccggtgatgaaccacgtcctggacatccaggtgatcctttctccgatggtcacctccactcttatccggaatcggggcggatcgaccagcgggcggcgatcaacgccagcggcgcgggcaccagccgcggcgccggagccggcccaggacgtcctcggcgccgtagacacccagcatgccggccagaccggccaggaccggagcgacgaagtcagcggtttcgagatgcatgtccaccagttcggcggcccgggtcgcggaacgtggtgtcgatcgggtgccgaccggtttctcttcgcgcggtcgccttgatattgatagaggacagcgggtatcgccgagccagaggcactacaggaggcgaacatgtcatcggacaacgggggtttcccggcctgggtggaggacaccggagccgcggggccggccgccggcccctggtcctcgttgccgccgccgcccgcctccctggtcaaccggggtgcggtcgtgccggccgccgcgccgctagctagctagccggccgagttggcgcaccgcgccgcggtcgcggcggtgcagcgcagcctggacgggccgaaaacggtggtggtcgtcaacccgaagggcggggcgatcaagaccaccaccaccctgatgatcgcccgcacgctcggcatccaccgcggcgggtacgtgctgggctgggacaacaacgagacccgcgggacgatgggctggcgggccaatccggcccggcacaccaacaccgcggtggacctgctgcgggatctggaccggttcgccgacgtgcgcagcgcccgggtgggtgacctggacaactacgtccggtcgcagggggacgcgcagttcgacgtgctcgcctccgacgaggacgcggagtcctcggccagcatcgacgcgacggcgttcaggaatctgcaccggacgctgagccgcttctaccgggtgatggtggtcgacaccggcaacaacatgcgggcgagcaactgggaggccgcggtcgccgaggccgaccagctggtgatcgtctccacggtgcgcgaggacaccgcacagagcgcggcatggatggccgacgcgctgaacacgtccggccgcggcgccctggtcgcgaacgcggtcaccgtgctcgccgacccggccgcggtcgccgaccgggcgctgcgggcccgcctgcaccggcatttcggccagctcacccgggcggtcgtcgacgtgccgtacgacccggcactgatcggtggcgggccgatcgcctacgacgcgctctcgccggccagccacgcggcgtggctgcgggccaccgcggccatcgccgagggcctctgaccgggaccggggcttcgcgccgacagtgtcggcgcgaagccccgggtgctcaggcggtccggtcgaccgcggccagcaacgccgcggccagcccgcgggcctgctcggtgtagaaaccgagccgcaggtggaagtcctcctcggtgccgaacatctccggcacctggcggagcaccaggtagatcatgcgcagttcccggtgggtgaccgccagctcggcgccggtggtcaccgccggggtcagacgctcggccagctcggcgagctccgctttcgcgaaaccgaactggaccagcatccggtccggggagatctgcagctgggtgatcacccgcagggcctcccggacgaggttcgtctcgaacaccgcgagggcgacgacgtacgcgccgtccctcgcggtcagcctgaccttacgagacattgagcggcacgtatctcggtccacctttgttgttcttcaccgtgtcgaagacgtccgcggcgtacttgtaggcgtggatgcggtagcccacgtccacgatcagcaccccgccacggctcgggtcgaaggcgaccttggcccccgtctgggtgtccttgtgcgtcatcttgccgacccagcccttcaggtactggccgatcttatcgggatcgtggccgaggcccgggatgtcgtggtccgcggcgctcggcgtgccgtcgtgcatccgctccaccatgtggtcgacgccggcggccacctcgttgccgtaggccttctccagccgatccatcgccgcgtcggtgaggccgccggtctcgtcgtcgaactccccgcagttgtgcaccaggaccggcgtacgaccggcgagcacgtagaacgtgtgcaggtcggcgacggtcaggttgtacatccaccgggacccgtcgtaccgctgcacgccggtgaccggcacggtgccgcccgccggggtgcgcagcgtgtcacccgcggccaggtcaccggccagggtccaccggtgtgagccggccgcccagaacgggtggtgctgcgtggtgcgcagctccccgcccgtggcgaccgagacgtcggccaggtcggtgtccaggttgaggtgcaggtcggtgaccgtgcgaccggcggtccgcccggtcagcgggtcggtggccagcacccggtcgccggtgcggacgtcccggatcggccgggtcgtgccatcggcgagcagcacccgggtctccggggcgaagctgtcccgcttgcagatctcgagcaggttctccagctcttcgatcaggttcttgccctcgggcagattcttgacgagatcctcgacggcggggaagccccgcttgtcgatgacgatcttcatcaggttgagctcgatgttgctgaacttcaacttgttcgggaagtcgacggcgatctcgatcagcttgccgagcttgatcgcgccgagcttcttgagcgccgcgtccatcgcctcggtgccgaacgtcttgatgccggccagcagctcgccgtcgagcagcttggcgatggccgccgggatgccgtcctcgagcagcttgatgccctgcgccgccttgccgatcttgccgatcgccagcgagccgatgtcgaacgtccagaggccgaagaacttggcgtactcgccgttcttccactcctccaggtggatcagcgagcccgggttctggatcgtctgcttgatgccgtcgaccagcatgtcgcaggcttcctcggagtccggcgtgttgccgggggagttgccgccggggccgaaggcgcacagcccggccagccacaccccgccgagggtgccgatcgcgccctgggtgatccccttgaggtagtcacgcaccgacgggtcgtcgaacatcttgtcgatgaacttgtcggcctggtcctgccaggtcttgatccaggacgtctgccgggcccgcttctcggcgtcccgcagctgcgcgacctggtccaccgcgccggtcaggttctgcgcgagggtggtcatctccttggcgaccgacttcatcgagtcggcgaccagcttgcccgacttggccgccgcgtccacctgcttggcgatcttctggacgttgtccgcggccttgtcagcggtgttcgcgtagctgcgggcgttgttggcggcctgccgcgcgaccccggcgtcgtgcccggcctcgacggccatccgctcggcgccctgcgcgtacgacgcggccacccgtgccgcctcggtggccgagctgaccgccttgatcgcggcgttggcctccttggccgcgccgatcgccgcgtcgatggccaccttggacgccttgaccgcccgggccgcctcggcggccgccttctgtgccgcctggtaggccggtttgatctgctcctgggccttctccgccatctccgccgcgtgctgggccgcggcgtccgcgtcgacggcgtgctgctcggcctgggcgctctgctcggtgccgatcagcatcgcgttgttcgcgatgtcgacggccatcgccgcgtcgttgtcggtcggtgcgtacgccgaggccacgtcgatcgccgacgcggccggatcggccagggcgagcgccgagacacgggcgttgagcgcggcccggccggcgatccggctctggaacgacgcgatcccggcctcctgggccgacgcgtccgccgacgacctggtcagctcggcgttcgacttcgccgcggtggcctggttgatcgcggcccgcgccacgttcaccgcctgccgcgcgtattcgttggcccgctgcgcgtcgccgatcgccttgttcgccgccgccgccgcggccagctagctagctaggccacggccgccgcgtcggccgccgccgcggcgctgttcgccgcctgccgcgaacgcgtctcggcgtcgcggatcccgggcagctgcgcgtcgatgatctttacctgctcggcggcgtagtcgccctccgccgtgcccttcttcgcgatggcgtcggccgcgtgcgcggtccggctcaactccatcgtgttgcgctcattgatccacttgttggcgtcggccgccttcgtccgcgcgtcgctggcgagcccctcgaaccgcttggcggacgcgttgacctcgtccgccgcgctcttcgcggcggtacccttcgccacggcgatcttctgctggtccaccgcgcgctgcgccgcgcccatcgcgaccgtctgctgctgcagcgcgaccgccatctggttgcgcgcgatgtcccgctgcgccgcggcccgctcgtagtgctccttggcctcgtcggccttcgcccaggcctgctgcgcctcatcctcggcccgcagccgctgggtgtgcgcggcggcctcggcggccttcgccgccgcggccagcttctccgcctggttggcgagcttggtcgcctccgccaggttgcgctccgcggcctgccggtacttgaccgcgttggccatctcgaccgtcgcgttacggtcggcgtccagcgccttggcggcggcctcggtcgcctcggcggcgctgcaggccgtgtcggcggccagcttcgccgccgcgcccgcgtccttctgcgcctgtgtgacctcggcccaggcgaccccgtgcgacaggccggtctggaccagcgtctgcgccgcggtggcggcgacatcggcctgcgcggtcacctgaccggcgttgcgcgcggtggtggccgcctcggcgcaggtgtcggtgtgcagcctggtgaggtcggcggtgtgcgtcttcccgccggccttgcggatcggcaggtccgccgcgtagatcgcgtcaccctgcttggcgtaccggttcgtcagcagcatcgagttggccgtgacggtcagcgagctcgtcgccgacacgctggcccggatgatcgtcgtgcgggcctgcgccgcctgagtggcccgggacgccagatcagccagatcaccggccgctttggtacgcgccgcgagagccgcctcgatctgcgcctgagcgtcggtgtcgcgtgccgcggccgccttgtagccggtgttgtaaaactcggcgatcaccgccgggtcctcactgtccagcgccatctgcccggcgctgcgcacctcgtacccgccgccggcgacgatctgctccacccgcgccttgatcagcgcggcctgctgcgccgcggagagctcggcctgcttgtcggcggcgaccgccgcgtccctgcccaccgcgacgaaatcggcgatcttcgtggcgttgccggtggccagcgccgccgccgcccgctcccgcaggatcgggccgccggtacgggcccactcggccaccatcaaccggttggtctcgtcggccagcttctgccgccggtcggccgccgcccggtacaccggcagcgcgttgtccaggaaagcggtgaactcggcggggtcgtcggtcagcagcaccgcggcggccgccgcgcgcacctccgcgtccgcgtcgtagtcggccagatcctggatcagcatccggttgagctcgacgtcgtcgatcgggccgtcggcgagcagtcgctgttcccgctcctgctcggcgacccgctccatctcgacgacctgggacagggtcaacggccgggccgcggccgccggccgcggcgccgcctgggccggcaccgacaccgcctgcggcagcacggtcagcaccgccagcacggcggcggtggtcagccgcccgggtaaaaatcgcgcgcgaatatggtcgctgaacatgaaacccccgtagatcagacaagcgacgcaggaaggatactttgaagtggatgaatgaccggcaccgccctccggcgatgccggggtgcaattcgggggcagggcgcgccgagtcctgaatccggtgcccgccgggccgatcgggcgaccatgaaccaccggatgctcgcgctctacctcgccatgaccggtgtcgccaccgtggcggcggccgtgacgacgggcacccggtacggcgacccggtgtacttcgccacctatctcgcgatggtggtcctgctctgctggtccacggcgcgccggcgacggcacggggatcaactgccctggctgtacgtgtcgctggggcaggtcgcctggctgggcggggacgcggtctatccggtcagcgcgctgctgcaccgcgacgacgacggaaccgtctcagcggtgctgtggaccgtcggctatctggcgtacggcgccgcgctcgtggcgatggcccggcgccgggccggtcgctggctgcggcccgcggtgctggacatgctcaccctggcggtcgcggcctcgatcgtgatctgggtcgtgttcgtgtcgccgtacctggccgagctggccgccgacccggtcggtgcgtacctgtacctgatgggtccggtcggtgacatcggcatcctcgccggcgtcttcctgctggtcctctcgcccggccggcgcaccggtgcgacccggctgctgctgctctccgcggtgctgcgggtcgcctccgacctggggtccaccttcatcccgtcggacaagctgtcgctgaccgtcgggaccaccgtgatcctgctgagcaacgcgctgctgaccgggtccgcactgcacgccggcagccgggagctgacgctcgcggcacaccggccgccgacgctgcacccggcccgggtctggttcctcgggatcggcctgctgacggctcccgcgatcctgttcgcccggcgcgagtatcccggaccggagcggctgctgctcttcgtcgccacggtgaccaccgcgggcttcatcctggcccggttcgccaccgcgctgcgctcgctggaacgcgccgagcgcacgctggactaccgcagccggcacgacccgctgaccggactgctgaaccgcgccgccctgggcgaggaactcgaccactgtccgcccggctccaccgtcctctacctggacctggacggtttcaaggcggtcaacgacggcgccgggcacgcggccggcgacacgatcctgcaggcggtggcgcagcggctgaccgccgcggtccgcgactgcgacacggtggcccggctgggcggcgacgagttcgcggtggtgctgcacggcctcagcgacgcggagggggtgcgggtcgccgagcgcgtcctgcgggatgtggcgatgccggtggccttcgagggcgctttttaccacgtcggcgccagcatcggcatcgccggcacggacgccgccggccccaccggacagtggcgccccgccgccctgctgcgggccgccgacaccgcgatgtacgaggccaaacggctcggccggggccggtacgtgctggctcaggccgcggcctgaaccgccggcccgcgccggctgccgaggtagccgaccagggccacgatcagggccgcggcgaagaccaggcccgacggcaggtagccccagcgcagggtggtcgcggtcaggtcgcccccggcggtgcccagggcgaaggtgaccagcacggtcgcccagtagaagagctccggacggccgtgggtcacggtgtggatcgacaaagtgcgttcgctgaggtaccaggtgaccagcacgacgaccagcgccagcgagaaggcgacggtcgacaccgggtaggggatgccgaggccgacgtgcaggacatcggcggccatcgtgccgaagacgctcaccatcaccacggcgaaccagtagacgccggtccggtagcgccgggacctgagctggacgatcaatgcggccgcgagcgccagcccggtgatccccaccgcgaccggcgggtcgatggtcttggcgaagaagtcggacgcggtctcgcccatcccggtggtcagtaccttgatcacccagaacatggcggtgatctgcggaaccttcaccgcgagcgagaccgggccggccgtgcgtagctgttgttcgtcgatcgtcacggccggcacgatgcgctaccggcgctgaaagaacgctgaacagccccgaaagggagtagccggcccagggtgccgacgagccgatcaaagaggggtttcgctgcgcggcggcgaggtcggtggccatgctggcttggtgacggcttcgaaggggtccacggtgcgggtaaccggcagacccggtgatccggcggtgatgccgcccggccgggtgttcatgacggcgctgctgggcagcctggccatcctgctgggcggccgcctcttcgacaacgtcggagacgcctggggaaccaccgtcctgttcgtgctggtcgtcctggcgacctcggccttgaccgccgaactcacggcccaggcgcagcgggaccggggccgctgcggcgggtgggcgcgcatggacaccggcatcgtcctggcgctcatcgtgctcgccgggctgctcctgacggcgtccgccatcggcgtcaggtcggcgggcacgcagaccgccgcggagcgtttcaccgtcctatacgtcctgctggcggggtatttcgggttcgtgcggctccggaccatccgcgggcgctgaggtgaagctgccgggaatctgacggcaggttgaggatgacttgaggtgggcggcccagtatttgtcacatgacagcgacgatgacgccggggcaggccacgatcgacacgttgcactcggtgctgcgctcggaagcgatccagccctccttccaaccggtggtccggctggcggacggcgagatcgtcgccttcgaggcgctggcgcgtttccgggagcaccacttcgccagtccggaccaggcgttcgcggctgccaacgcggccggcctcggcgtcgagctggaactgctcgccatgcagcgggcgctggcgtcgctggacggggtgcccggtgacgcctacctgagcaccaacctgtcggtggaggcgatcctggacccgcaggtccaggagacgctgctggcgaacgcgcaccgccgtctcgcggtcgagctcaccgagcacacccaggtgcacgattacccgcgcctggtcgcggtcaccgagcggttccgcgccgcgggcatcctgatcgcggtggacgacgccggcgccgggttcgccagcctcagccacatcctgcagctgcgccccgacatcatcaaactcgacatcacgctgaccagcggcatcgacaccgacccggtgcggatggcgctggcccggtgcctcgccggcttcgccaccgacatcaacgccgtgctggtcgccgagggcatcgagaccgccgccgaacacgagaagctgctggagctgggagtacggtttggccagggctatctgctcggccgtccggctccgctcccgcgcattgcccactccctgaacgcagaatgaggtcatcttgaacatcgcgacgcacgctgtccgcatgacgaaatcccccctcgccgccgccgagcccgcccgttccgccgtctccgtccgcgacgcatgggagccgctgttcgagatcctcaacggcgcgccggcccgcgacggacgcggcggccaccgccccacggtcacccgccactcccggtgaccacatggccaggtggaacctgagctgcgacgattcggctgagcaccgggcagtttcggcgtgtcacgatggtggggtgagcgcttctcctgcccgcctgaccgccgcccgcagcgccggcctgctgctggccggcgcggtactcggggccggcctgacgccggtgcccgccctcgccgacggccccggttacggcggcaccgcgaacgccctcaccgtcgcctggaacgccgggtccgagcagcgaggcgtggccgtctacgcggtcggcttccgcagcggctcgcccgtccaggtgcgggtgggaggggaggccgagcgcagcgtcaccgccgacccgtccggcgcgatcgacatggtgctcaccgccgcgaccacgaccgctaccgccgcgaccgttgcctccgccgccgtgaccaccgccaccgccgccgcggccggcaccatcgtgctggtcagcggtcacaccccggccggcgagctgcgcaccctggtcggcgcggtcccgccggaggcagccgggatcggcgtcgcccagctcgtgccgtgggccgccacgctggtcggtctgggcggggccgctctctggctccgccgccgctatgccacggtcgccgccgggcagttgagccgttaccgccaccccgcccgccatcgcgcctgacgccgcagagctgaccgagctcgtcgatcaacctccggctccggcacagcagcgccgcgggccggctcccgccctaccgagggcggccacgctgaatgcccggtaggtgagccgcgtggggcgtcagcgccgagcccgacgtgttcttgcggcggtcgccacacggatgaggaagcagtggtgcccgggcccgcacgttcggtcaaccgagtgacagactcgctccgtgatgatcagtaaggccgacgcggatgacatcgcggatctggcccgactgctgtggcgagatacccgcgacgaggatccgtcaagccagtccgttgacgccttcgctgaggaactcgcgcagtggtggggctcccatcaacactcccacgcggcgttcgtcgctcgactcctcggctcagagatcatcgggatggcctgggtcgcgcttctcccccgggtaccgaggcctggggcgacaagtcggctgtccgcagacctgcagagcgtcttcgtcatgccggagcaccgcggacaagggataggctccgcgctcgtggaggccgcttcagagtatgcgacccgcctcgggtctcttcgcgtgacggtccagtctggccgcaaggcggtgccggtatacgaacggctgggcttcgagtcgtctcggcagttgttgcagcggatggcgcactcgtagaacggccccacatcggcaaatccgtgcacgcgaagagctcgtcttcgatgcgacctgttgtgaccgggtgtcatccggcggaggacaggcgctgaagttgtcagctctcgttgaggtagccggccatggcgatcgcggcggccccggcggcgcggtccacctcactcaccgcggcggccagtacggcgatgtccaccgccgcggcggccaggcgttccactcgggcgcaggcgtcggccaagggctgggcgccgaggagcgcgctggacgacttcagcgtgtgtgcgactgcgccgagccggtcatggcgggattcggcaagagcgccggccatggcttgccggcggccgtcgagctcggtcaggaaggtgccgacggtcatcgcgaccagttcccggccttccagctgggcttccaggtcgcttagctgggcccgggagagcacctcggcgccgggctccgagaccggtgcggccggcgagccggcgccttccggctccgcgaccggcgcaccgtccgcggcgggcgaagaaggcgtggcgggcgaagagggcgcggcgggcgaagagggcgcggccggagtggatgtcggcgcggcgggcgaagagggcgcggccggagtggatgtcggcgcggcgggcgacgaaggcgcggccggctccgtgggggtcaggtagggcgccaacgcccgccgcagctccaccagggtgatcggcttggtcaggtagccgtccatgccggcggccaggcatcgggcgcggtcctcgggcagcgccgtcgcggtcagcgccaccaccggcacgacgcaaccggccgagcgcacccggcgcgtcgcctccaggccgtccatcccgggcatctgcatgtccatcagcgccagctggtaccggttgtcgccgagcagctcgcggaccgcggccgccccgtccccgacggtgtcgcagtcgacgccgagcaggctgatcatgcgggccagcacggtgcggttgacctcgttgtcctcggcgagcaggatccggccggcgggcagcggcggcagggtcaccggcgcgccccgcacgccggtgcgctgctggttgagcgcggcgacgagccggtcgagggtgaccggcgcgctcagcaggccgggccggcggaccacgccggtgcgcgggtcggtgccgctcagcaacagcgcccgcccggtggagcccagcgcggccaggatcatctcggcccggtccacggccgccgggtcgtgggcgtcgtcgcaccacagcacggtgtcgacaccgggccggccggtggtcaggtcgtcgaggtcgagcgggacggcttccgccccgccggccgtgaccagccaggacagcgcctgccgggagtgggaggtcggcgcgctgatcccgatccggcgcccggtcagcggcagcgccgacgggaccgggcccggcagcggccgcaacggcagcgtgatcgcgaagcgggaaccgcgtccgggttccgagctgacggtcagggtcccgcccaggcaggcggcgagccgccgggcgagcggcaggccgagcccggccccctcgtgccggcgtgccgccgagtagccggcctgcacgaacggttcgaagatgcgttcctggtcggtggccgcgatgcccggcccggtgtcggcgacttcgaggcggtagtggtcggtgccgtcgggccgggcggtcaccaccacctcgccgcgttcggtgaagcggaccgcattgccgaccacggcggcgaggatctggcggagccggtcggcatcggcctcgacgaccgccggcagttcgggcgcgggcgcggccagcaacagcagcccccggtcgcgcgcctcctgctgcaacggttcgagcacgctctccaggacgtcgcgcaccgctgtgggcgcgacccgcggcaccagcgacccggtttccaaccgggccagatccagcaggtcgtcggtgaggtcccgcaggttgcgcaccgcccggtgcacggtgtcgaccgtctcccggacgtcgggcggcagactctgcgcacgcaacagatcgatggcggcgaccacggtggtcaccggggtgcgcacctcgtggccgagcagcgccaggaactgctgccgtccgtcgacggccaccgcggtctccacggtgatcagccgccggtgcgcgccgcacgtgctctccaggccggtgacccggaccgtggcggcggaatcggggccgcagtgacaggccggtgcggtggtcgtcccgggtcgggccgcccggaccagctcgggcagccggccgtgggcgggacatcccgggtcgccggcggtcagcggctcgccttcggcggggccgggccagcgggagttggcgaccaggatccggccgtgctcgtcggcgatcgcggccgggccggcgacggcctcgaccagcgtgcgggcggcgaaactcatgcggggaccccttcggtgaggtggctgccctcgaccggcgcgggcaaccggcgcgtccaggcgcggatctcggtcgccgcgaccaccagcagggtgggcagcagcgccgccgccgagcaggcggcgatcgcgagcggcgagccgtgccagagctgaatgaggccgacctcgagggcgacgcccgcccacggcagccaggtggcgcgggagtggcgggccagcgcggcgttggtcagcacggtcaccaccgaggtgacgccggcgaccacggcgagggtccggaccagggtggtggcgccggcgtactggtcgccgtagagcacggtcaggaccaggctagctagctagcggcccgccgaccgcggcgaccgcggtgcgcagtgcgcgggcccgaccgggccggtcgtgcgccgcggccaggcgggggaacaccgccgacatgaccgcggcgggcagggcgagcaccgtcttggccacggtcgcggcggcgacgtatgcgccggaggcggtcccggccaggtggtgccgggccagcagcaggtcggcggtggagaacaggaacaggccggtcaccgcgacggccgcgccgcccacggcccgcggccgcagccggacgccgggcccgggatccggacggcgggtgagtcggcgggccgccgtcaccagggccgcgacctcgccgaacagtgtcgcggtgagggcgccggccacgccgaagggcacggtcagggcaacccccagagccagccgtacgacggtggccgccaggtacgagccggcgaccgtggacacctgccggtcgccgagcagcagtccgcgcgcggtggccagcagcgccgccaccaagatgtacggggcgagctgcgcggcctcgcccagcccgtcgaggtggaagtagccgctcagcagcggcgcgccggcgagtgtgagcagtccggcgggcagcgtccacagcgtgaccgctcgcaggctgcgcaacgtggtggcccgcccggcgccgtgcgtggccgcgtgcgccgaggcggcggtctgcagcgcgccgagcgggatgccgagcatcaccatggcggccagcacggcgcccagtgccccgtacgcggccggctcgagaagccggccgaccagggcgtgaaaggcgaggttaccggcgctctgcaccgccaccgccagcgcgatcgggccggcggcgcggagcaggaagccgcggccgcggccggaatcgaactgcacggcgtacctatcggcgggtcagcggcgatgctgccgaaagtcgctcatgttctcgtgtcggccggaataatcgtgacaaatgaccgataagttgctgaccccgttgccgagccgggcggacgtgctggacaccctgaccgcggtcctcaccgacgccggcctgccgtgggcgtggcagggcgcgaccggtgcgccgcagcgctggtgtgccggcaccgggccgagcgatctcgacgtctggtgcgccgggcccggcccggtggccgcgctgatgagccggtacccctgcgcggtgatcgccgcgccggcggacccgcgccggctgcgccacaccagcctcgcggtgctgaccggcagcggacccgcgatcgtcgacgtgacccacggtgacctgcgtgtcgggccggttctgctggtcccggcggccgaggtgacccacgatccgggcagttgccggctgaccggcgcggccgccgtcgccgatctgctggtccgcccggttctgcggggccggatcccggaggtcggccggctcgccgaggctcggggagcctgggccgaggcggacgcggcgcacctgtcggcgctggccggacggctgacccggcagctcggcgcccgggttacggcggatctgatcgcggccctgcggggtgcccgacccgatccgggcctgccgcgccgggcccggctgcgcctggccgcccgcagtctcgggccggggaccatcggtgccacctgggcgcagcggcacggcgtgctgccggccggccggtccgccgggccgctgggtctgcgcacgcgcggggtggtggtcgccctggtcggtaccgacgggtccggcaagtcgacggtcgccggggcgctgcacgaacgactgcgggaccacgggttcgccacagccacggcgtatttcgggatggcccgcggcaacctgcccggagtggccctcgcccggcgtctgctcggcgtcggctccacagcgccgcagacggggaccgctccgcaggatcgaggcactccgcggacgacggccgagcggacgacggccgagcggacgacggccgagcggacgacggccgagcggacgacggccgagcggacgacggccgagccgatgacggccgagcggacgacggccgggccgctcgatcacgcccggttgcggcggatggcggcctggttctacgcgggggagtacggctggcggtacctgcgcacggtcgcgccggcgctcgcccggcggcaggtcgtgatcgccgatcgctgggtgtacgacctgcgggactccccgtggccgggctcggcggcggcccggctggccgagcggatgctgcccgcgcccgacctgctggtgctgccggacgcgccggctgaggtgatccaccgccgcaagccggagcgtcgcctggacgagcagcgcgcgcagcaggagcggttccgccggctgctcgccgaacggccggcccgccgcgccgagctggtggtggacacctccggcgaaccgggcgccggcctggccgccctggtcgccgcggtgatcgaggcggcccacgcgccccggcggcgacgccggtgagcggcggtcagggctcgaagcggtagccgacgccgcgcagcgtacggatgtgccgcggcgccgaggccgactcgccgagcttgcggcgcaggttaccgacgtgcacgtcgatgatgtggtcgtcgccgaagaagttgtcgccccagacgtcctcgagcagcttgcggcgggtgaaggtacggcgcggcgcggaggacagcaggtccagcaggtcgaattcgatcttggtcagctcgagcacctcgccggcccgggacacctcccgcacctcgaggtcgatccgcagctcgccgtattcccggaccgcctcgcgccgggcctgggtggtggcgcgcggccggcgccgcatcgcctggatgcgggccgcgagctcgcgcggcgagaacggcttggtgacatagtcgtcggcgcccaccgagagcccgaccaccttgtccacctcgtcggtgcgcccggtgaccatgatgatgtaggcgtcggtgaactggcggatctggcggcacacctcgatgccgtcgacgtccggcaggcccaggtcgaggatggcgatgtcgggccgctgcttctgggcgcgctccaccgcctccgcaccgtcaccggcggcgaggacctcgaagccctccttctccagcaggtgacggcagatcatcatgaactcgggcgagtcctcgacgacgagcgcacgtggcttggacacggcacctccggtgacgggtggatcgttactgacctctgatcggccgcgccggccggaatccaaggccggacgggacatctctcaggcggaaacggcactctcccgggcctggtgcaggagctcgatgaagccgtacgcgtcgagctcggcacagtcggcgacgtccaggaaaccgatccaccggccctccgcggccgagacgccggcctgccacgacgcctcccggtccagccgggcggcgtgcacggtacgggccagcggcaggtcgctgagctcggcgacatcggtgtcggccaccgcgaccagctcgaagctgatgcactgggcgtagagcgcctcggccaggcgctcgatcaggtagcgcagggtggcggcgggcccggagagcggcagcaccagggtcaggtcgacggcgccgcggccggggcccggtacgacggcggcggccgggcggagcgtggcggcgggggcggtgagctgcgaggtcggcatgcactgagcatggcggtcgtacctcaagcacagctcatcccgaggtcagccggtcggcaagaccgccgaggaccgaccggtaggcgtcggccgtcagcgccgtcgcccggtcccagcccatgtggtcgcgcgccgacgcgcgcccggcccgggcgtaccgctgccacgccggctcgtcggtgagcaaccggatcagggcccgggccagcgcgcgcgggtcggccgggggcaccgacaggccgttgacgccgggttcgaggaccgcccggacgcaggcgacgtcggtgccgaccacgggcaggcccaccgccatcgcctcgaccagggccatcgccggcggcgaggtggtgtagtcgaacttgaacggccacgcgccggcctgcgccgcggcgaactcgccgagcaggtccggcaccgggtcggtgaccacgtcgatcgcgtccccggcggctccggcccgggccaggatggcggggagttcgggccgcgggatgagcagcagccgcagccgcacgcccggcacctcggcgcgcaccgcccggaacgcgtcgagcagggtgtccaggccgcggaccgtctcggcgcggccggcgaagacgatcaccgggtggtccgggtcgaagcgggcccggcggtcgtcgtccggagcgccacacgcgtagcggacgatcgccgggccgccgggccggcccaggcggtcggccacccgcgggtcgggagtcagcacggtcgtcacgccggcccggcgcagggccgcggccgccagcggcaccggcagcacggtggtgagcgccacccgtggccgtagcacattcgacgaccacatctcggccaggccgctgcggcgccaggcgaccgggccgggcagcgtcggccaggcgtagaccgtcagcaccttcgggtacggccgcagcgccgggtgcagggccatcagtggccccagcgcgccggcgtgtaggtgcaccagatcggggcggatcccggcgagcgcggcgctcagcggggcggaccggcccagcgggaacgtctccagcgggccgccgagctcgtgcgcgccggcgaagacctcggcgccgtcgacgacgtgcgtggtgatcaggtgatgctcgccgggcacccgccgcacggtctcggtcacggtacgccccatcgcctcgcgggccgagaactcggcgatgacgtgggcgacccgggtcacgcgcggaccgccgggcggaccgtggcgagcgcccggccgcggaggtggccgatcgcgccgaaggcgaactcgctgatcttcatcagccacatcccgccgtacagcagcgggtgggtccgcagatagcgggcgttgcgcaggtagagagccaaccggtgcaggatgttggcctgccaccggaacgcctccggatgcacgcgcgcgaacacgtcggcggtcgccgcgtacccgagtttcttgcgcagcgtgcgggacagccgcaggtcgccctcgttgtggtagaggaagttgcgggtgcggccgacccggcagccggccgcgcgtacccgcaggtcgagatccttgtcctcggagaagaccatccgctcgtcgtgcccgcccagcttgtcgtagacgtcgcggcgcaggcagcgcagcgactcgatctgcgcgacgccgtcgtagcacttcttctccagccacttgcagcgtgcccagaacgtggtgccgaacgactcctccgggatcaccacggcgtcgtaggaaccggccagcaggtcggcgcactcgccgagcaggccgggtgtgatcatcatgtcggtgtccaggtggagcagcacctcgccggtcgcctcggccgcgccgcgccggcggccctgcgccatcgaccggttctccttgagatagcggacgtccagtccgcggtcgcggaactcggcgaccacccggggcgtctcgtcggccgaccggacgtcgtcgttcacgatgatctcgaagtcccggtacgtcgagccgaggaacgacgtcaggaactcccgcaacagggcggcgctgttgaaggccggcacgaccaccgacagcgcgggggttcgggtcatgagccccagtatgggtgctggtccggcgtggccgggcgggtacgacgacgatgggccgggactccgcgagccccggcccatctcagccgcatcagtggatcagtagtacaacggcagcatcaccgcccagtagaccagcgtcgtcgcgtcggccaccgtcaactccggcttcgcgcccagcgacagcgccgtcacccgagccgtgtacgccgtccagcggtgtcccatcaggtcggcgtccagctgcttgagcgtgaccgccgatgcgcggggcagatccttgtgggtcagcgcgatcagccactcgatcgtcggcttgacgctgtaggtcagctggaccgcgggggccgcgttgcccgccttgtcgacggcaccggagcagatcaccgtgtgcttgccgtagctctcgtagtcggacagggtggccttgccggcgacaccggacaccgcgtccgcggtgacgcaggtgaccaccggcgcggcgtccgggccgtagaccgcgccgttggtcgcgccggcgatggtgacgaccggggcctgacggtcgacgttgagcgtggtgccggtgctcgcggtgttcccggcccggtcggcgacggtgccggcgatcttctgggcggcgccgtcggtgaccacctggtcggcggggcaggtgaccacgccggagcggtcgtcggtgcaggtgaacttcaccgtcggggcggccgtgtaccagccggcccggttcgcgctgccggtcaccgtggcggtgatctgcggcgcgacccggtccaggttcaccgtggtaccggtgctcgcggtgttcccggcccggtcggtgaccgtgccggtcaccttctgtccggcgccgtcggtgccgaccgtggtgccggtgccgcaggcggcgacgccggagcggtcgtcggcgcaggtgaacgtgatcgtcggggcggtgttgtaccacccgttggtgttcgccgtgccgccgctgatcgtggtgccgatactcggcgccacccggtcgaggctgaccgtggtggtgacggtggcgctgtttccggccaggtcggtggccgtgccggtgagggtgcgggcggtgccgtcctcggtcagcggggtgtcggccgggcaggacgcgatgccggatccggtgtcggtgcaggtgtagtggatggtgggggcgtcgtggtaccagccgccggcgttggcggtggcgccgagcacggtggcggtgatggccggcgcggtgcggtcgacgttgaccgtgaccgaggtggccgccgtgttgccggccgcgtccagcgcggtcccggtgacgacctgacccgcgccgtcggtgccgaccgggatgtcggccgggcaggacgccacgccggatccggtgtcggtgcaggtgaagtggacggtcggggcgtcgtggtaccagccgccggcgttggcggtggcgccgagcacggcggccgagatggtgggtgcggtcccgtccacgttcacgatgaccgagccgctgccggtgttgccggcccggtcggtggcggtgcccgccaggacctgtccggcgccgtcggcggctgccgtgctgtcagccgggcaggtggcgaccccggaagtctcgtcggtgcaggtgaagtgcaccgtgggtgcggtccggtaccagccgccggcgttggcggtggctccggagaccgtggtggtgacgcccggcgccgcctggtcgacgttcacggtgaccgaggtggccgccgtgttgccggcccggtcggtgaccgtgccgctgaccttctggccggcgccgtcggcgctgaccgacacgtcggccgggcaggccaccaccccggaggtgccgtcggagcagctgaagtgcacggtgggcgcggtggtgtaccagccggcgggggacacgtcgccggtgaccgaggcggtgatcttcggcgtggtcgggtcgacgctgagcacgacggtggccgtcgcggtgttgcccgccttgtcggacgcgatgccgctgatcttctggtccgccttgccggcgctgaccacggtgtccgccgggcagctggcgatcgtcgaggtctcgtcggcgcaggtgtagtggatggtcggcgcggtggtgtaccagccggccgcgttcttggtgccgagcaccgtggcggtgatcgacggagccttctggtcgaccttgagggtgagcgtggtggtggtggtgttgccggccgcgtccttggcggtgccggcgaaacgccgggccaggccgtcggtgttggccaggatcggcgccggacagacggcgaccgtgccgctgtcgtcggcgcaggtgaactggatggtgaccggcgtccggaaccagccgttcaccggcttctgggacagcgtggcggtgatgctcggcggggtccggtccggtccgttgtccacgacggtgctggtggacggccaggtcgcgtccgttgccggcgggctgccggaggcctcgaagaccgggacggagccgctgaccgcgctgctgccgccgttgtcgttgtaggccttcacctcgacgatccaggccttgtcggtggcgagggcgagggtggtggcggtcaccgaggtgtccagcttcagcgtcttggtgaccttgtcgatcccgtagccgacctggtaaaaggtcggcgcgggaccgttcgcgggcggcgtccagctcaccgagacggtgcccggagcctccgcgagccgcttcacgaccaggtcggtcgggtccgccggccggaaccggtcgagcagcgacttggcggtcacgcaggcgccgtactggttgaccgtggtcaccgccagcgtgtaggcccggctcgggtcgatccccgggtaggtgaacgacaggccggtgctcgtctggtcggccagcacggcgccgtcggacagccgggtgaacaccgagtggtagccggtgagcggcgtgtatccggtccaggccggctcgcgccaggtggccaccgcggtggtgccctcgtcgatgcgggtgggcgccatgcccatcaccgcgctcggcgtcagcgcccgcagcgaccagaagccggtgttggcgaccgtgccggccgcgtcgaccgcgccgatccgcaccttgtacgcggtgcacgggttcggcgcgtcgatcgtgtagccggtcgccgtggccggcaggtcgagaaccgtctccacgtcgccggccaggatgtcgatcgcgtagtggtcggcaccggtgaccggtatccagccgaccttgatctggtgcacgtcgtcggcggcacgggccaccgtcaggttcttcggcgcggccagggcggagagggccgcggccggcgtggcgacgagactcgtcgccattgtcgtcagaacgccgaccgcgccgagcagtcgtcttctgtccatgcggacctcttctccgggcagctttcgtcgggggtgttcatcggctggcaacctcaatccggcctcaggcgggggtatggctcaggtcaagctcgggagcggccaccacgggcggctcgcccggtgtggtggccagggggagggtgaaccagatccgcgcgccgccgcggaactgcgggtcggcgccgatggcgccgcccaggcgttgcacgatgcggcggcagatgggcagaccgagaccgtttcccgggtacgcgtcggggtgcgcccgatgcagctcctcgaagatcgcctcgtgctgtccgtcggggatgccgatgccgtggtcggtcacctcgatccggaccatgtcgtcgtccagcagccgggccgcgacatgcacccgggcgatctcgccgtgcggcacgtacttgatggcgttgccgaccaggttctccatcagccgccgcagcatgccgtggtcgccccgcacggcgggcagcgcgtcccggcgcacctgcggcgccgggcggaccagctcggccgtgtccgcgaccaggtcgtcgaccagcgcggccagatcgatcggggccaggtgcagccgagactcctgcgtcgtggcgtaggtgagcacgtcgtcgatcagctgccgcatgcggacggtgcagcgggtgatctcggtgacgaactcgtcgtactcggccgggcgcggatagccgacgtccaggtgttccagcagctgggcgtagccgcagatgccggcgagcggggccttgaggtcgtggctgacgtcgctggcgaacgtgcgcagctccgccactgtgcgctcgagctcggtgttgcggcgacgttcccggtccagctcggcgcggagctcggcgagctcggtgccgggcgacacaacgttgttcgacaccgtgggcctttcgtcgtggcggttcatcaggccatcacccgggacttctcgtcaccggtctgcaagcgggtgatcaggtggtcgacgccggggtcggcgccgggggtcaggtacggccgcagcgcgctgcgcagctcgggcagcgtgatcggcttgctcagccgcccgttcatcccggcggccaggcacagcgccaggtcggccgggtcggtcgcggtcagggccaggatcggggtcggcgagccggccgcccggatctgccgggtcgcctccagcccgtcggtgcggggcatctggacgtccatcagcaccacgtcgtacgggtcgccgccgagaacggcctcgaccgcggcggcaccgtcgggcaccgcgtcgcacgtgacgcccatcagctcgatcatgcggcggaagaccgtacggttgatgtcgttgtcctcggccagcagcacccggccacccggcagcggcggcacggtgaccggcgcgccgcggaccccggtgcgctcccggttcagcgcggcgaccagccggcgcagcaccagcggggcggtcagcaccccgggccgccggacgatcccggtgcgcgggtcggtggtgctgatcatcagcgcccgtccgtccggaccgagcgcaccgatgaccgtgtcggcgcgccgcaccgccgccggatcgtgcgcgtcgtcgcaccacagcaccgtgtcgacgtccggcagagcgcccgtgacatcggcgaacgtcaccgggaccggctcggcgccggcgctcgccagcagccaggtcagggcccgtaccgaacggtcggacggcgccatcacggcgacccggcggcgagccagcggccgtggttgcccgtcgccgtccggcgacgccgcgggcagcggcaggcggacccggaacagcgccccggcgcccggccgggattccacctcgatggcgccgtccatccggtcgaccagccgggcggccagcgccagaccgagcccggcgccctcgtgccggcgtgccgccgaggagtcggcctgggtgaacggctggaacagccgggcctgctgcggctcggggatgcccggcccggtgtccgagacggtgaccaggaggctgccgtcggcggccggctcggccagcacgaccacctcgccggacgcggtgaacttgaccgcgttgccgaccagcgccgtgagcacctggcgcagccggaccgggtcgccggccaccgtcgcgggcagctgcggcgcgggcgcggccagcagcaggatgcccttgttgcgggcctgcgactgcagcggctgcacgacgccttcgagcagttcccggatcggcaccggctcgcgggtcagggtcagccgcccggtctccaggcgggccaggtcgagcaggttctcggtgagggtctccagggccttcgccgagtagtggatgtcgtccgcgatctctcggacgccctggtccagctgctgcgcccggagcaggtcgacggccgccacgacggtggtgaccggggtcgtcacctcgtggctgagcagcgccaggaactgcgaccgcgcggtgtcccggcactgctcggcgacgacggtgaccagccgctggtcctcgccgccgggcccggtcaacggggccacccgcagcgtgtgcacgatgtcctcggcgcaccggcagcacagctccgccgcgccggcgccgggggtggcccgccacaccgcctcgagcacgccgcggtgggcgccgcacggcccgggcgcggcggtgaggaacccaccctcggccggatagagctcgccgttgccaccggaccactgccggttggcgagcagcacgcggccgtcgggatccaggatcgccgcggcgacggggatcgcctcgacgagagtgcgcgccgcatatcccatgcgctgacctttcgcggggaagtcagacccgaagcaggcccgtgcccccaggctcggcgagcttgggggcaaatgccgtggaagtcgggagcgatccggtttcagaccgcgagccggcggcggccgcggtaaccaccgggagccgcgacggggtgaccgctgcggcgccgcaaccgggcacccagcccgagcgtgacggcggcgagcgcgcccagggcccagggcaggacctcgaccgggccgcgtccggtcgcctgcggcggaaccgcggagaccagcacccgggcggctccggaggccgagcgaccggccagcacgatgctggtgccggacgcgccggtgccgaccagcgactgcggcacgtcgacctcgatccggccgttctcgtcgccgcgggtctgctggatcgggctgctgccgagccgcacctcgaccaggtcccgggctcggtacccgaacccggtgacccgcagctggttgccaccctcggcccaggtcagcaccagcttgtcggtgctgctggagaccgcggccgcggccgggccggcgacggccagcagcgaggcgcaggcgccgagcaggatcagcatggcggcgacgatgcggcgggcggcggcgagcttgagcatgcatcgagagtgcggcatgccgaccgggtagcggaacgcctccgggtcaagcttgcccacctcctgagccgggcttgagccgggcgaccgcggggcccgcgctcagccggtcggcgcggccgccgatgggaagggtgtccgaagatgtccggaggtgtgcgtgtcgctagaccacgccgcgcccggcgtgcggacggcaccgggccggcaccggcgcccctggcacctgccggagctggccgaccggctgtgccggcgcgcgctcaccgtggccgccgggctgttcgccgcctgtggcccggcgcatgccctcggcctgaccgatctggtgttctggaccgtgctggtcgggctcgggctggccgctgccgcggtgcccctgggcctgttcggcctgcggcacggggacaccgcggattgatcaggggcccgctgaaccgggcggccctgctcgccgcgcggccgtatctgatcgtgctggcgatcgacgtgctcatcgtcagccgctggttccggaccggcacgttcatcgccggcggcgacatgggcgcgttcatcaggcgcggctgggcaccggagatgacctggtcctggaatcaccagctgaccggcgccgggtcggccggctacaccatggcgcgggccttcgagttcctgctgatctggctgtgccggcaggtgggcctgaccgagtactccgcccagtggctcttctacacctgcatctacgggctggtcggcttcggtgtggcgtacctggccggcgcgttcgtgcgctccgggccgggcatcgtggtggccgggtcgttcggcatgctcaacgggttcttcctgacccggctgccgaacccgctcaacgtgatctcggtggggtcggtcgcgttcgtcaccggcgtcgcgatgcgggtcgcccagggccggcgtgttccggccccgatcgccgggttcgcgctgatgccgacctcgttcctgagcttcaacccgccgatgctggtggtcgcctacgcctgggcggtggccggcaccccggccctggccgcgctgctgctcggccggcgggcggcgggccggctgatcaaatggttcgtcgcggcggtgccgtgggtgatcggtctgaacgcgtggtggctggtaccactggcgcagagcttcgtgggcggtggcggcgccaccgcgaacgcgaccttcaccgacccgaccaactggtcctggtcgcaggtgaacaacctgccgccgaacatcctcaccatggtggcgaactgggcgtggttcctgccgcagtacctgccgttcgccgccgacctggaccggccgtggtggatctggatccggtatctgctgccggcgctggtgttcgcggccccgctgctggctccgcgtcggttgcgccgggtcgcgctgggcctgctcgcggtgatcctggtcttcgtcttcctggccaaggggctgcgtccgccgctggccagggtgaacctgctgctgtacctgcacgcgcccgggttctggctgttccgcgagccgatgagtaagctcgggcagctgctcgtgtcgttcttcggggtgatgctcgcgatcggggtggccgggatgccggccgtggtccggcgggtggtgccccgacggcgcccctacgcctacgcggcggcggccatcccgttgctgctggtgctggcctaccccttcccgatctacaccggcggggtgatgccggacgagcgcccgagccagccgtcgatgcacgtccgggtggcgcagcagtggtgggacaccgccgcgcgcatcgatgccgatccgcgccccggcaaggtgctggtgctgcccctcgacgactactaccagatgccgaccacctggggtttcttcggtgcggacagcatcgcgaacctgttgatcaagcatccggtggtgcagccgaaaccggagggctacttcggtgacgtgcccggcttcgccgcccacctgcggctggtcgaggcggcgctgctggccggggacctcaccgcggtgccgaagctgttggacgcgatcggcgcgagccgggtgatcgtgcggcacgacctggtccgcggcctgccgaaccgctatttcgccgacgaccggctgctggccgccgcgatgacccgggtgcccggcgccaccctggagagcgggggcctgctcgacgtcttccggctcggcgacggtgccgacccgacggtccggacctacgatcgggtgctggacgccccggcccgccccgaggccggcgccgcggtgctcggcacggtggacacccggaccgcgatcgcggcacgccgggacacctcggtggccgcggccagtccccaggtcgacgaccacccggcggtcaccccggacgtggtgtactggccggtcccggcggtcgacgaggggtccccggtgaccaccgtcgacgtgccggcgggccgctacacggtcgcccagcgggcccgggccgccccggcgctggtgccccgggtggacggcggtgacctggtgctggccgacccgaccgtggtgaaggtggacgggcggccggtctcgcgccgcccggagctgcgggtgccgctgccggccggccgtcgagtcctggcgatccgggcgggcacccggcgtaccgtgtcggtggatgtcgcgaagccggcgccggtgccggtcggcgcggccaccagcctcaccctgctggccgccgccgcgaagccggcgaaggtcagcggattcagcccggtcttcgactgcaacagctacgagccgcggccgtggcgcgagctcggcctctccgcgaaggtcagcgacacgaagcagggccggaccgtcacgctcgccgccgccgaccacgccgcctgcacccggctgatcgtcagtggcgcgtcgcccggggagatctaccgggtccgcctggagtatcaccgggtgtccggcgcccggccgcagatctgcctgtggcagtccggcgccgccggctgcgagctgtccgcgcggccctcgctcagcgacgactggatcccgtacgagggtgtggtgaccatggacgccggcggcgagctgcagatcatcctgcacgccgacgccatccgcagactcggaccccggaccgtcaccgagtatcgcggcgtccaggtccaggcgctggagcaggtcggcagccgggaggtgtggccgccgtcggtgccggagaccgccgtcgagctcaccgcgggccggcacgagctgcgtgtcgacggcgggcaggcgggctcggtgctgtccccgttcgagccgctggaggactgctaccgctacgacgaccagaccgccgagcaggccgggctggccgccgaggcgcagaccggggtggacggggagaccacgtacaccctgaaggcggtcagccacctggcctgcatcggggcgaccgccggggtcctcggcgcctcggccctctacgagctgtccctgcaggcgcgcagcgtcgcggtgcgcaacccgaagttctgcctgttcctgcgcggacccgacctgtgccgcaagctgccgtcggtggccgtctatcagggctggacccgctacgagacgttcatcccgccggatccggacaccgtcgagacccgtctctacctgtacgggctgcgcgatctcgccggcaagcagcagtcccaggtggagtacaagggcgtccggctgcgtccggtggcctcggcctcggccgtcgtgctggtccggcagaccgccgcgacgccggcctcgtcggcggactggacgcggcacgatccggcccacttcgccggcacgctcaccgcctccggacccaccatgctggccctggccgagagcgcggcgcccgggtggcggctgaccggcatccccggcgcgacgaaggtgaccctgcagggctggatgagcggctggcgactgcccggcggcggcgggttcgcgctgtcctacggcccggcccggatcgcccgctacgccttctacctgctgccggtcacggtcgtggtggccggtgcgtacatgtacggggtccgcctgcccgccggccggccaggtgactggaccgcccggcaccggcggcgccgccggctcccgtggcggctcctgaagtggccccgccgatgaccgccctcgtgcgccggctgctcggcgagcgatcccggcggcggatgcggtgggcccggcggcacaccgtgctctgtgcgatcgggttgctggtggcggtcctggcggcagtggtggtcagcacgccggcgagccgccgcctgatcgtcgggccggacacggtgaccgtggtggccgtcggtgacatggcgtgcgacccggcggacccggacctcaagcgggccacccgggagcagggtgaccggtgccgtcagcaggccgtctcggacatcgccgtggcgctgcgcccggacgccctgctggccctcggcgacgtgcagtacgagatgccgaccgccgaggcgttccgcaccgtgtacggcccgagtttcgggcggctgcgcgaccggactgtgccggtctacggcaaccaggagtacaaggtgcaggacgcgtcgtcgttcaccgcgtacttcggcgaccgaatcctcgacaagcgtggctactggtcgcagcagatcggccgctggcacgtcgtggtgctcgactccaactgctccgcggtgcccggcggctgcggctccgggtcaccgcagcagacgtggctcgacgccgacctggccgcgacctcgagtcgctgcgtgctcgccgcctggcaccatccacgctggtcgaccggcatcgccggacccgacgaccggaccgcggagctgtatcgcaccctgtaccggcgccgggtggacctggtgctgtccgggcacgaggcggactaccagcgcttcgagccgctgaacccggacggggtggtggacccggagggtgtccggcagttcgtggtgggcaccggtggccaggcgcactaccgcccggagggcaccgccgccaccggtgccccgccgggcgcgtacgcggactacgaccaccacggcgtgctcgcgctgacgttgcgccccgcctcgtacgactgggcgttccatccgctggaggccggccgggtcaccgaggacgagggttcggcgcgctgccactgagcgccggtcaggccgccacccgcatcgggccgcgagggcagcgggcctcccgctcgacggcggtgagcagcgcggcggcgacctcgtcccaggagtgcgcgccgccgtagggcagcggttcgggcgcccggcgcacccagcccggcagcgcgtcggccagccgttcggccatcgcctccgggtgtggcggcaccacgatcccgtgcgccgcccgggtcgagtcgcgcagccccggcacgtcgtacgcgatcgtcggcgtgcccagcgcggccgcttcggtgaccaccagtccccacccctcccgcacgctggcggccaggtgcacgtgggcccgggccatccggtcgtgcttgtcctgttcgctgacccggccgaagaactcgacaccgtccggcgcctcgtcggccagccggtccagcagcggcccgccgccgagcatccacagccgcaggccggggaccgcggcgcgggccagcagcaccgcccggatcacgtcccggggccgcttgtagttcaccatccgaccgcagaacacggcggtgggccggtcctccttggccgggtggggcagcgggtggggtggctcgtagccctccggcaccacggtcacgtcgtgcgcgccgaaccgggccagggcctcccgggtcgactcggaaacggccaggatcgggctgccgcccagccgccgcagccagttcggctccagccggtgccggcccaggtgcgccagcagcggcggggcgttgatgtgccagatctcctcgcaggtctggtggaccagcgcgatcgtccgcgcgccgtcgtcgacccactcgtgcgcctggaacggcaccgtgttggtctcgtcgacgaccacgtcgaaccggccccggccgtgccgctgccaccagcgccgtgcctcccggtagacggtgaaccggctgccggcccggacgatccggtagccgtcgcggatttcgtccgccgggcgccccgccaccgccgcggcgaagagggtgacctggtgcccggccgccgcccagcggcgcagcacctgctcggtgtacacctcggcgccgccggacgcggggtggctgaggtcgcgccagttcaggatcaggatgcgcatgaccggggagatcggccgggacggcaccgggttgagaacgttggggatatgaccccgcgacgccggtggattgccgatactggcacaaatgaccgagcaacggcggaaccgggcagttggtggccggccgcccgccgcgcgacaccggcggcccgccccggccacccggctgaccctggagtccacgctcgtcggcctggtcatcgggttgctggtggtggcgccgtggacccgcccgggttatctgctgctgctcgactgggtggccgggccgcacaccgcgctcacccccgggctctacggactcgatccggcggcgctcgacgccctgccgtaccggctggtcacgcatgcgctgcgggccgtcgtcggggcgggcgcgaccagctggctgatgatcctggcgtacttcccgatcgccgccgggggcgtgtccggcatcgccggggggagccggtggcggcggcacccggcggcggtgttcgcctgcgtcaacccgttcgtcgtcgagcggctgcatgccgggcacgtgccgttcctgctctcggtcgccctgctgtgcccgttgaccgcgtcggcgctgcacgcccgccggcgcggcggctggttcgccgcccgcccggccggttggtacgccctggccatctcggtcggcgcgcacgccgcctggctgggcgggatggtgctgctcgccgtcgcgttgctgccccggcccggccggcgacacctggcccggaccgccgtcatcgtcgtctccgccggctgcgtctacgcctatgccgcggcggtcgtcgccaccgcgattctcacggtccgggtcagcgacgaagatcttgaggtgtacgcgacgtacgccggcgcctcgggtctgaccgcgaccgtcgccaccctgcgcggcttctggcggggtggctcggacagcagtccgcagctcgctctgggcgtggtgcccggcgtgatcctggtggtcgccaccgtcgccggattgatccggctgtgccgccgggaccgtgccgtcggggcgccgctggccgccgtgaccgccaccgggctgctgctcggtgcgggcatcaccgggccactcggtccggtgtaccggatcgccttcgacacgctgccgctcttccatgccatgcgggagcagcagaaatgggcggcgctcgcgatgatcggctacgcggtgggattcggcgcggccgccgaggcggtggccctgcgctgccgggccgggcgtccggtggcaccgcgggcggtggcggtcggggcggcgctcgccctggccgggatgacggccacggtgagtgggtcgctgttctggggcctgggcggcagcgttggggtgagtcactatccgccggcctggtacaccgccgaccggatcatgggggacggcgacgagtcgatgctgttcctgccctggcaccagtaccaacccttcaccttcaccgcggcacgcagcgtggcgacgccggccggcgccttcttccggcggccggtgctcagcagcgacgcggtcgagctgggcccggtgcggagcaactcgtcgtcgtaccggatggcgtatctggatcggttgatcgccgccggtggcggcgggagtttcgggcggctgatcgctccgctgggcgtgcgctacgtcgcgctggcccgcgaccgggagagcggcacctacgcctggctcgaccggcagccggatctggaaccggtgctgcggaccgccgccctcgacctgtaccgggtgacggtcagcgggatcggccgggtggtgagcgcccgggacggggactatgccgcgctgctcgcctgggccgcgcgggggcggctcggtacggaggcggtgatctccggggccggcggcggaaccgtgccgtccgcggcgtcgggtggcctgcggcgcgtcggctcgacccgctggcgggtggcggcgggtgaggccggctgggtggtgctgcccgaggaatggtcggcgggctggacggcgggggatcaggtcacccggcgcaccgtcgcggggacggtcgcggtccatgccggttcgggggccttcacggtgcgttacgcgccgtggaagtggttacggctgggtcttgccgcgtcgttgctgacgctggtggcgctgctgggcgccggtctcgtggagcatcggcgggagctgtcgccgcggttcagacggcggcctggcggtagtggccgccgaggtgccggcccaggatcgtgacggtgtcgcgcagcgtgcgcacgatggtgttggtggtgacggtgctgccgttggcggcggtgttcagcgcgaccggcgcggcgtgcaggttgcggatgccggccgccttggccgccacgaagaactccaggtcgaaggcgaaccgctgctcgcgcaggtgcgggagcagctgggcgagagcgtcccggcggatgatcttgcagccggtctgggtgtccttgacctgcagcaggaagagcagggtgaccagggtcgagtagaccatcgagatcagcttgcggaccttcgaggcgccgctgaccgactgggcgtggcgcttgtcggcgtagacggccgcgtggtcgccgccgcgggccagccccaggtaggtggccaggtgcgccgggtcgatgtcgccgtcggcgtcgatgaagccgacccaggcgccctgcgcggcggcgaaaccctggtgcagcgcgctgcccttgccggagttgagccggttgtcgatcagccggacctgcggcaggaacggcacgtgcagctgcgagccgtcggtgctgccgtcgttcaccgcgatgatctcgtgcccgatgccggcggcggtcagcgtcgcgatgatcgcgtggatggtctgggcgacgaccgggccgcagttgtagaacggcacgaccacggtcagttcgacaccggcggtggccggggcccagaggttcgggctggcgaccggagcgacgacggccggggcggcgaccggggcggcggtgtgtgcggggcgctcgagcgtggcggttgcgttcatgtccactacggtcgagccgcaacctcaagctgaggtctagcccgattcagtcctgcgacaagcttgccgatcggccgtggccgcaggcggcgagggcggacaacgggagttttcccggtgtcccgtaccctttcgccgcatgagcatcggcaaaggtgacctcgcgcccgacttcgcacttgcggaccaggacgggacgctgcgcaggctgaccgatctggtcgccgacggacccctcgtcctgttcttctacccgggcgcgatgaccaagggctgcaccgcggaggcatgccatttccgcgacctggccgccgagtaccgcgccgccggggtgcagcgcgccggcatcagcagggacccggtggccaagcagaaactcttcgccgacacctacacgttcgactacccgctgctttcggatccggaatcaaccacgattgcggcgtacggggtgaagcgcaagctgaatctcggacctctcagcaccaaacggatgaccttcgtgatcggcaccgaccgccgcatcctcgacgtcatccacagcgaactcgacatgaaccagcacgccgccgacgctctcgcggtcgccgtggcggcccgggcacagcacgggtcataacaggggtggtcagggcgtcggcgccccgctggaggccggcgcccgttcaggtcacgagggcagcggggcgcccagcaccgcggcggcggtcagccggaccgactccagacggtcggcgatctgcgtcgactggtgggcgacgatcagctcgtcggcctgggcccggtcggcgaacgaggtcagataggagcggacctcgtccggggtgccgaccgccgagtaggtcatcatcgccccgatctgccgcccgttcggcgtggtcaggaactcgtcgatctcctcgtcggtgaagtcggtggaagcggtggagccggccgccgagggggcgcccgccgggccggtggaacggctgatcaggccgcgcacccggatccgccgggtgatcgtgaactgctcgcgggcggactccgcggtcggtgcggcgatcacgttcacgccggcgatcacgtacggctgcgacagctgcgccgacggctggaactcgctgcggtaggcggcgaccgcctcgtacagcagacccggcgagaaatgcgaggcgaaggcgtagggcaggccgtacgccgcggccagccgagccccgaacatcgacgaacccagaatgtagagcgggacgtgcgtgcccgcgcccggcgtcgcccggacccccggcacccgtgactcgtcccccaggaaaccctgcagctccagcacgtcctgcgggaagctgtcggcggacatcgggttgcgccgcatcgcgcgcatcgtcacctggtcgctgcccggcgcccggcccagccccaggtcgatccgccccggatggagcgaggcgagcgtcccgaactgctcggcgatcgtcagcggcgcatggttgggcagcatgatcccgccggcgccgagccggatcgtcgacgtccgcccggccacatgcccgatcagcaggctggtcgcactggacgcgatccgtgccatgttgtgatgctcggcgtaccagacccgctcgtagccggactcctcggcggcccgggccagggccaccgcattgtcgaacgcctgcgccacggtcccaccgggcgtgatcggtgcgaggtccagaatcgacaggcgcggcttcgccgagaaagtgctggtcataggagaaggaaacgccgccgcccaccggcggtgttcccgccgtgcgggagaacacatcggcgctctgccggaccccggcggccgggctacgatggcgcccgtgtccgcgcccctcgaccggcaccgcgccgaacgccggcgcctgctcgccggcatcagcgaccagctgcgccggcgcggcatcccgtcctcgttcgggcagctcaccccctactacgacgggtacggccgggcgccggccgggctgaccgggctggtcgtcgacgagccggacggcccgggcagcttgcaggtcaccgtggtcaccgcacaccgggtcgcggaagcgtccggtgacccgctgcgccgggcccgcgacgtcgacctggaatacgacctgaacggcgaaatcctcttcgaggtgaccactctggatgtcgcggtcggcagtgccgccgtctggtcgccacggctgctgaccggcagcgaggaggcggtcgtcgacgcggtccggttgtggcacggctaccgggacacgctgcgcgccaccccgccgctgcccgacccgaaacggccggcccgccacgccagacagctcgccgggcgccgcgcagccgccgccgccccgcgggtccgggtcaccggcgaggccgccgcaaccccggatgtgtccgatctcgatcacgcccggctgtgcttccacttcccgcgcgaccgcaccgggcggtattcgcgccgcgccgtggtcgccctcgccggctacgacatcaccctgggtaaacggggccggtggctggccgcccgggcgtccggcgacgagctgaccgtcggggtcgaggcgctgatcgacgtcaaccaggaccaccgctgggatcagctgccctggctgtggcgggcctccgcccgggacaccccggccacgctgcgctggcaggctccggacgccgaccacgtacaaccgatcatcgatcttctgcggcgccatgagatcgccgaggcgctcacgctgtgcggggtcgaggtcgacgagaggctgtccgcgctgctggccggctacccgatcagctactcgcaggcgcggtacaccgagacctgggtccacaccctgtacgaccgactggccggctcggcgccgtggcggttcgcggccggcttccgtgcctggcagcaggaacggcgccgggccgggcggtccgaccaggccgaggtcccgctgttcggcctcaaaggcctcaaccagcagtcgagaccgatggtggcgctggccgccccgcgcggggtgtgccggctgcggatgatctggtcggccggcaacgcccgattgccccgcgccctctgggagctacccgccgacctcggcgagtagcgccgcgagttccgtcggcgcggagaacatcggccagtgcccgccgggcagctcccggtacgtccacccggcgccggccatcagaccgaacgccggcaggttcgccgccatctcccgcagccgcgccgccgggaaggaacagaggattgccgtacgcggaatgtcccgccacgcctcgccgtgccgcaccgggccggtcgcggtcgcggccggctggggtcgtccgcggtcccggacgatcgcccagtcgaagccggtcgcggacggcggcgcctcggcgggcaccggcagcatcccgtcgaccggcaccaccggctcgccggtgaagtcggcctgcgacatgccgtccggcagcggtcccgcatccacgtagaccagccgtcgcacgtgggtggcaccctgatcggcgaccgcggtgatgaccagcccgccgtagctgtggcccacgagcaccacgtcgtcgagcttctccaccagggcgaccagctccgcgatgtggtcgtcgaccgtcgtccccggttccaggcggggcgacacctggtgcacctcgtggccggccgcccgcagcggcccggcgaccgcatcccacgcccagccgcccagatggaaccccggcaccagcacatatgtcgtcatggcggccaccgtaggcgccaatccgggcgaaaaccgcccggtatatcgtgtggcccgtgccacagtcactcggcaaggttctcgggctcctggagctgctccaggccgcgcccggcggggtcaccgtcggccacctcgccgaccggctccaggtcgacgagcggaccgtccggcggtatgcggggcagctcgccggcctcggcatcccgatcgagggccggcgggggcggcacggcggctacacgctggcgcccggctaccggctgcccccgctgatgctgaccgacgaggaggcgctcgccgtcctgctcgggctgctcgccgcccgccgggccggcctgaccgtcaccgcggaggcgaccgagaccgccaccgccaagatccagcgggtgttgccgcacgcgctgcgggcccgcaccgatgcgctgctggccaccctggacttcaccgcgacccgggcggtgaacccgtcgaccccggacaccggcatcctgctcaccctggccgccgcggcccgggaccatcgaccggtcacgttcacctacaccaagctagctagctagcgtcgggccgggccagccggggactgagccgggccgccgccgcgtcgacccgtacggcctggtcttccacgccgggaagtggtttctgaccggccacgaccacgaccgcggcgcggtccgcaccttccgcctcgaccgggttgccgccccggtcccgctggccggcacgttcgcggtgccggccggcttcgacccggccgcccgggtcgccgagggtctggccaccggcgcctggcggcacgaggtgtcggtgctgctcgacctggacctcgacgaggcccgccggcgcatcccgcccaccgcggccaccctgcaccgcaccacgcacggcacccggatgacggcccgcgccgagcgcctcgacgggatggcccgcatgctggccggcctcggctgccccgtcacggtcgagaccccggacgcgctgcgcgccgagctgcaccggatcgcggcccgcctgcgcgacgcctgacccgggcattcgccggcgaatcagcaggaccgccgggcgcggaaggcgaccatgttcatccggttgccgcagcggaccgtgcagaagcgtttggagccgttgcgggacaggtcgatgaacaggccggtgcagtcgtcggcggcgcacacccgcagccggtcggtctcgttcatccgaatcacgtcgatcagggcgagggccgcttcgacgcgcaggcgttcggcgagcggcgcgtcgggctcggtggcgtgcatgtgccagtcggagccgtcgtgccgggtcaggtacggcagggcgcgggcctcccgcagcatccggttgaccacggcgacggcctcgtcgcggctcagcgtccacacctcgcgaatctggtcgcgggtatgacgtacctcgcgcagttccttctcgtcgttgtcgatgcgaccggagaaggtgttggtgatcaggagggtgcgcaggtcgtcgacggtggcgagttcgtcgtcgccggatcgggacgcgccggccgcggtgttggcgaggaccaccgcgaactccagcgcctcctcggtgtcaggggcaaagagcaatttgactcctcactcaggcgggcctagcgtcaggggcgttgccaacttagcccatgacgggggagccatcgtgaaactgtcgccgcagtccgccggactggccgcggcggtgctctccgccgcctccttcggcacctcgggcgcgttcatcaagccgctgctggaggccggctggtcgccggccgccgcggtcaccgcgcgggccctggccggcggccttctgctgctgccgctggtgctgttctcgctgcggggaaactgggccgcggtctggcgcggccgcgggcggatcgccgcgatgggcgtcgtcgcggtggcgttcacccagctcacctacttcgccgcgatccgccgggtgccggtgtccacggcgctgctgatcgaatatctggcgccgctgctgctggtgctcggggcgtgggcgacgacccggcggctgccccgcccggccgtgctgctcggctcggtcctcgcgatcggcggcctcgtcctggtgatcgggccgggggcgctgcaggcggtcgacccggccgggctgctgctcgcgctcggtgcggcggtcggctgcgcggtctacttcgtggtcgccgcgcgccccgccgacggtctgccgccggtcgccctggccgggctcggcctgctgctgggcggcgtgatcctcggcgtggttggggcgaccggcgtggtcccgatggccgtggcgaccgggccggtggcgctgctcggcacgtccacgccgtggtggctgccgctcggggtggtcgccctgttcggcaccgccatcgcgtacggcgcggggatcttcggcggcagccgcctcgggtcccggctcgcctcgttcgtcggcctcctcgaggtggtcttcgcctcgatcctggcgtggatcgtggtcggcgagcgcctcaccccgctgcagatgctcggcggcgtgctgatcctggccggcatcgccgccatccccgccgagccggccgttcccgtcgtcgccgctgatcgggccggcgtctccggcccgaaggtggcgcgcagcggcgccccccggtagtcgtccttcacgatgcgcccggacgtccgggccgggttgaacgggtggtgaagacgggcgcgagagttcgccgcaccatgccgccgcattcctcggaaccatcggcgggcttcgtctcctgccacgcctcggggggctgacgtcccggtggctggtgccccgggccgggcgcgggtcggctaccgtgctggcggaagtgccgatgagtggcgcgggagtgccgccggtcgcaccgaggagatgcaggcatcgtgaccaccgcgcaacccgagccggccgtgcccggcgcggatcgccaggtcgcccggctccagccggccgggtcgtcgttcggcggcttcggcttcgcgcacgccgagcccgaagtgctgcacgacgtgatggccgagatcaacaagttcctgatggtgtacaagttcggcctggccgagatcggcacgaagatcaacatcctggccgaggagctggcccaccgcggtcgcggcaacccgatcgagcacgtcaccccgcggctcaagacgatggccagcatcaccgccaaggcccgccggatcgagtgcccgctcaccgtcgacgacctgcgcgcccggatccgcgacatcgccggcatccggatcgtctgcggcttcgtccccgacgtctacaccgtcgcccggatgctcacccgccagcccgacgtgcacctggtcaccaccaaggactacatcgcccagccgaaggcgaacggctaccgcagcctgcacctgatcgtcgagatcccggtcttcctctccgaccaggtggtcgccgtcccggtcgaggtgcagctgcgcaccgtcgcgatggacttctgggccagcctggaacacaagatctactacaagcacgacgcggacgtgcccgccgcactccgcgccgagctggccgccgccgccgaggacgcggcccgcctcgaccagcgcatggagcggctgcaccaggagatccacggcccgcgccactgaggcttcgcggtggcacttccggcccgtacgggggcaccgggtgagagctgccatgccggcgctccgccgcgatccgccctggtcggcggaatcacaggtattgcgacagatcaggaaaaaggtgcggcacgctgtggtgatgacagtgcggagatgcgcagcttcaacgatctgttccgccgtagcggtgctggccgccggatcgccggccgcggccagcggccccccggccctcgccggcgacccgtaccacggcaagtgcggccgcgactcctacggcgtcaacaccacggtcatcaccgaccacggccacctgcacctgaccgaccccgccaccggcaacgagatcggcgacgcctacttcttctacacgcccagctgccacggcttcttcgtcacgagcctgacccgcggcgacaggtactacaccagatcgaccgtgtgggcgagggaccgcaccggcccggtcgccggcttctcgtcgttgtatccgggcaacggcatcgcctggacatacgtgctgggcaacatggccggccacgccgcgtgcgccgaaatcgccgtgaccacgccgcacggccgacccgtcaccacgatcgacctcggctgcaccgcggtcatccaggaccaccgcaccgtcggtgttcccgtctgggccctcccgcccggacgaagcgatgcgccggaatccttctccgcccgcactctggccgagggggcccggggatcccggcggtgcagcgcgggatccgccgggacgccggtcagttgcctgcggtcaggtagtcgagtaaccagccggtcagagcgcgggcaatgccggccaggacaccggagatcacggcgaggctgatccgggtgcgatgctgcgcggggtcgctggggtgctgcggtgctgggatcatcggacgctccctggtgtcggacgaggcgcagccggcgtcggctgcgtgtccaaactcgggccccccttcgggggtggattccggtgtcgacggctgccgaccggtgcgcgcaggcggcccggcgcggcactatggatcggcgatggatgccgacgggtcccgaccagaagtccgccgtgccaggccggtggaacgcgtcgccctgccgcccgggccgatccgcgacctgcgggagatgctctaccggctgtacgcggaggcggactgtccccggatcgaccggttggccgaggcgattctcgcggacgacgcgctaccgggatcgccgcgcaaagacctgatcatcaagatcatcagcggtgatgggctggcgtcgcagcaagacaccgtcacggttgccgtgacgctggcccgagaggcgggccgcgacgacaccgcgccggtggccgagcaggtccggcagctgtggatcaccgcccggaccgcgccggcgcgcagcgacgacagcgtggtacgggtcgggcgggtgcccaggccggcggcctggttccaggacagatacgcccaccacgctctgctccgggcggcccgggccggccgcagtgtggtgctgacccaggtgctgtccggtctcggcggggtcggcaagacacagctggccgcccagttcgcccgcagcctggatgcggccggcgagctggatgtgcttgcctggatcaccgcggccaatcggcaggcgctcgtcgcgggttacgccgacaccgcccacgccctgcggttgtgcggcccggaaaccgagcccaccgcggccgctgaccggctgctgtcctggctggaacacaccagccgacgctgcctgatcgtgctcgacaacctggacagcccggccgacgcgaccggcctgtggccgccggacaacccgcgtggccgcacgctcgtcaccacccgacgccgggacgcgatcctgcacaccgacaatcgcaccatggtccccgtcggcctgttcaccccgcccgaggccgctgactatctcactcaggccaccggcaccaccgagccgcgctccgcggtcgactccctcgccgccgacctcggcctgctcccgctggccctggcacaggccgccgcgtacatccgtgaccacgggatcgactgcgccacctaccggcaacggttgcgtgagcacggcctcaccgcgagattgcttccgcccgatgacggcctaccggatgatcatcgcaccatcgtcgcggccatctgggacgtctccatcaccgccgccgacaaccatcggccccgcggcctggctcgccccctcctggaggttgcggcgctgctcgaccccaacggcatccccgacgccctgttcaccaccaccgcgatcaccgcccacctgggccgggccgggatcaccgcgccggacccaccggcgatcatcgacgggcttcacaacctgcaccggctccacctgatcacccatgacgttgacacccacgccgtcggcatccacgcgctcgtccagcacgccacccgtgaccggtgcacccccgcccggctcgctcccctcgcccgcgctgccgccgacgcccttctcgaaatctggcccggcgtcgaccgtgaccccgtccacacccagacactgcacgccaacaccaccgccctacgaacggccaccggcgacgccctgttcacccctcaagtacacaggctgctgtttcaggccgcccgccggctcggaaacaccgggcaggtcgccgctgccgtcatcgccgccgaacagctgctcacttcctgtctgcggatattgggccccgatcacccggacaccctggccagccggcacaacctcgcctggtggcggggtgaggccggcgaccgggccggcgccgccaccgcatacgaacagctgctcaccgaccaactacggatattgggccccgatcacccgggcaccctggcgacccggcacaacctcgcctggcggcggggcgaggccggcgacccccatgccgccgaacggctgctcgccgacccgtcgccggtgctcggcgcgccgaccgcggccggccctcgcagcctcgcctggcggcggggcgagggcggcgaccccgtcggtgccgtcaccgcctacgaacagctcctcgccgacaggctgcgggtcctcggccctgaccaccccgacaccctgatcacccggcatggcctcgcctggtggcggggcgaggccggcgacccggccggggctgtcaccgcctacgaggaactgctcagcgaccggctgcgggtcctcggccccgaccatttggacaccctggctacccggcacaacctcgcgcagtggcggggcgaggccggcgacccggtcggcgccgccgcggccaccgaacacctcctcaccgatcagctgcgggtcgtcggccccgaccatccccacgcgctggccagccgctacaacctcgcccagtggcggggtgagtcgggcgacccggccggcgccgtcaccgcgtacgagcaactgctcgccgaccaactgcgggtcttgggtcccgaccaccccgacacgctgatcacccgctatcaccttgcccactggcggggtgaggccggcgatcccatcggcgccgctgcggcgaccgagcacctgctcgccgatcagcttcgggttctcggccccgaccatccccacaccctggccacccgtcaccgccttgcccgctggcgtgaccgaaggccggattgaggagaacgcgcaccgctgtggaagaaagttcactgaggtactagcgccaatcggtttgtaatggaaacctattggcatgacagctgaaccggtacccgccggcggggatgcccgccggctcctcgacgatgtgaagtcgctcgcccatcaggtgcgggtgcatcagcggctcacctggatagcgctgctgatcctcggcctggtcacgatggtgtccatcccgttcgactactacggcatgatcgtgcactgcgtggcgtccggtgacggccaggcgtgcaggttcgagcggcgcggcatgctgctctactggccgccggcgctcctgctggcctatgcggcgatcgcggtgagttacgtgcgggccgcccgggagcgcgggctcggcgcgcgggtcatgccgtacgtggtgaccggtgttgccctcgtcgttgcgttcctgacctcgtgggtgctgttccgggtctacctgaacgggcacccgctgcccgacccgccgcacccgatgccgtgggcgctgctgttcctcgaccgtctgatctcaccgtggggcaccatcggcatcgcactgctggtcctggcccggctcgaacgcaacctgccgctgctggggttcaccctggtctacctggcggtcacgctgatcccgatcgacttcggctggcacatgaacagcgacacccgcaccgtgtggatcccgcagcaggtgatcgacggcatgctgttgctgctcggctccgccgggttcgcgtgggtcgcccggaggcagcggtgaccgccgccgcggagactccggaacatccggtcaacggcctcgacgacatcgtccaccagcgggtcaggctcggcatcctgaccatcgcccacgaggcccgccgggtcgagttcggctacctgcgcgcccagttgcagctcactgccggcaacctgtcgcagcacctcggcgtcctcgagacggcgggcctggtcgacgtcgagaaaggctatgagggcaaacgcgggcgtacgtgggtgaccctcaccgccgcgggcagcgccgccctggccgccgagatcggccggctcaagcagctcatcgcccgggtggagcagcgatgaccacgcgacggtcgctgctgaccgccctggccgcggccccgttccccggcgacgtcccacggttcccgcggctcaccctgccggcgccgaccggaccgttgccgatcggtaccgtcgcactgcacctggtcgacccggccggcggccgcgagatgatggccggcgtctggtatccggcccgggacatccgccgctacccggtcttcccgtggatgtccgatccggcgtggcgcgcgctgctccgactggtcgacctggaggcgccggtccgggcgccgctgaccgccacccgccgcggcgcgccggtgctgggggagcggctgccggtgatcctgtattcgcacggcaacgacagctgccgggccgagaccacgatcaccgtgcaggagctggccagccacggctatgcggtggtcaccgtcgaccacaccgggaacggggtcagcgagttcccggacggccggatcaccctgcccaccgacgacgacttcacgccgtgggacgtcccggccggtggccctggtgaccggagtgggcacacggtcggtatcggcgtcggcatcgccaaccggctggatgtccgacgagatcggcaccggcctggcccgagggccacaacagcgccatcatcgtcggatgacgacgcgacctcccacgctgcgcgacgccctgagaagctgcgtccacaccggcgagaagatcggtttcacgctgctcgacggccgccagtttctcggctgggccgccgatgtcgacggcgaccgggtgctgctcagctgggcgccgagcccgatgttcgccatgtcgaccgacgatgcccagtggaacccggacgacgagtgggtgccgctgagcgcgatcgccgccgacaccgcggcccgctacgacgaggcgtcgcggcgttggaggccgtgctgctgacccgcggtgtccgcccaatagcagaatgacaggtgcgggtcgcctgggcgcgcgttcatcgccgcactttccagacaggctgctactctcctggtaaatctgttacggggggtttgtggctgatgaggaaaattgcgggctccgccgcggcgatcaccgttttgttggccggaacgccggcgaacgcaacacctatcgatccatattacacgctcatcaacgcgaacagcggaaaatgtctttcgattggcgcctccaacacgaccagtggagcggctgccattcaatggagctgctggggcggcgatgatcagcgctggtacctgcgcaaatccaccgctggaacagttcgactggtcaacgtcaacagcggcaaatgcctggccatcggcgcctcgaacatgtccgacggtgcaacggcgatccagtgggattgtatcaacatcgatgaccagcgttggtatctgcgtgacgcccaaggcgcgaagaaactggtggcccggcacagcaggaaatgcctttcggtgggcgcctcaagtacggctgacggagcgaccgctattcagtggaggtgcggggacggcgacgatcagcgctggtacatgaactatcacgcttagttggtccagcagaggcgaaacgaaccgcgacggagcgccgggatcgctgttcgcggccccttgtcgacagatccgtccgaccttgagtcgctgagccgggagtttgccggaacagctccggccgccctgggtgaggcatgggcggatccggcggtggccagccggtcgatcgtctcgacgggcatgaggaaagcgccgggcatgaggaaagcgacgggcacgaggaaagcgatgtgccacgtctcgtcctcctggccgatcaatgccgggaccgtggcggcggagttgacgcaccagtgaaccgggacgtcaccggcgtcgccgatctgcagcgatctgcgggcagggtcggcgcggcggtcggctgtcgtggcgtacgccgcaatagggcgtcgcggtcttgaggccggcgatgaagacgcggctctgatcgcggtgggcccccggccgcgccgacggcgcggccggaagcgtcgcggtcaggaggaggtcgccacgaagtggcagaccggggcggtggcggacacgttcgtaccgtcggaggcgcggacgtaccagccgtacgagtggccgtcgagcagggccggcaccggcaccgagacggtgcccgtgccggtcacgaagtcgctggccgagcccgggccgcccaggtagatcggctgcggctggtgggggtcggtgttgtcccagagggagaagtcggcccggaccgcggccgtcggatcgtcgtccttgacgacggcggtcagccgtggggtcagcgacggcaccttgccgtaaccaccgttctggtgacagccggggtcgccggtgccggtcgccgggacggtgaccgtgccggtcggcacggcgggcagcatggtctgcgcggcgcgcagcttggtgatctcggtgctgctcagcgcgtacgggaagagctgcaggtcgtcgaggccgccccgatacccgtcgccgacggtgatcggggtgccgctcgggacgcgtctggtgtgcgtcgcggtgccggccagggtgccgttgacgtacagacccatcgtgccggcgaccgcgtcgtaggtggccgccaggtgtgtccagacaccggtctgcgcgggggcggtgacctggtcggacgcggcgccctcggcgtcggccgtgaccatcgcgaaccgccatctgccgccggtgtaggacaggtcgatcggccggccgttgttgtccgcctggttgagcagcgagccggcggcggtcgccgcgtccggtttcgcccacaccgagacggtgagcgcgcggcgggtgtcgaacttgttgacggtgccgtcgacgccgctggtgaccgttcccgagccggcgaagcgcagcgaatggacccgctcggcggagcgggtgacatcgtccgacagcgtgccggacagcccgttgatcgagccgtccgccgtggcggcaccgctggtctcgtcgaacttccaggtcagcgactgcccgcgggtgaacgcgacgagcggcgcatggtccgacaggcccgccgggtcgtccgcggccgcgacgttggcgtcggtgtcggcgaactcggtgagcgagtcgcagtaggcgaagccggaggtggcgaagacgtagtcgagcttctgccgggagaccgtcggcgcggcgtcctcgctgttgaaatgcgtcatctcgttgaccgcgtcgccgggcgagtaggcctgctggtcacattccgggtacgtgtcgaacagcggccggatcggtgaggtcgcggccgagccctgcatggtgttgaagtcgccgccgagcaccggcagggcgacggcagcgatcttctgcttcagcgacgcggtctcgcgggcgtactccgggtcggtggtgtgcagcaggtgggtcacgcacggcgtgttctgccagccgtcgacccgcacgcagagcaggttcgaggtgcgtttctcgtcggcgtccgggtagtagctcgggtcgccggcgaccagcagcggcgtgaccgtggacgaggtgatcgtgccccggaccgcgatcacctcgccgatcgtgccgaccaggtcgccgccgcggcagtcggatcggccgtccgggcgggccacgaccgcggtgcgataggtccagccggagccgagcgcggccatcagcggtgacaggtcgttgcggtcaccgccgcggccggcggcctcgtccggatagcagacctcctccagcatgaccacgttgagatcgcgctcgcggatgatggtctcgatggcggcggccttggcctgcggccgggaccgccacggacagtacgaggaactgccgcggctcccgccggcctccccgcagatgttccaggtcagcatgcggacggtctcgcgctggtagcccagcccgtcgggtgcggtggccgcggcctgcaccgccggccgcggcggtggctgctgcgtgacggcgagccggacacccacgacggtgctcagcacggcagcggtcacgcccaccatggacagtagtcttcgcaaaacgttcccccgtttcgatggcactcgatggcgatcgtatagacggggtgacggccgaacgacggtgcccggacgcccggatgtcggccgcccccgtggctgccgacatccggcggcgtccatggtgcagtgccgcgcttggcaaaaccttggcgggccgctggcggagtcctcctagacttcggctcgtggacttccagctactcggtgcggtgcgcgctgtccacaatgggcaaaccgtgcccctcggccggaagcaggaacggtgcgcgctggccgtcctggcgctcgacgccgggcggcccgtccccgtcgcccgcatcgcggacctgctgtggcacggcgacccgccgcaccgggcccgcggcgccatccaggcgatgatctcccatctgcgggccgcgttccgggccgtcgacccggagcatcactacatcgtcggcggggaggcgggatacctcctcgacgtcgcgccgcaggccgtcgacatcaaccggttcaccgccctggtcagccggggccgggcaaccgacgtgacggagacccgggcggacatcctggcccaggcgatggccctgtggcgcggcccgctgctcggcgacatcgcggacgacgtgctgcgggcccggctcagcccggacatcgacgaactgcacctgcaggcgcgggaggactggctcgcggcccggcttgagctcggtgaccacgacgaggtgaccgcccggctcaaacgcctggtcgacgagcatccgctgcgcgagcgcgcccgccggttgctgatgctgtcgctgtaccgcggcggccggcgtcaggaagcactcgccgtgtaccgcgacacccgcacggtgttcgtcgaggaactgggcctggaacccggaccggagatgcagcacctgcaccggaccgtcctgtcggcggaggcggccacgcccggtctcaccgtcgccgacgccccggtcgcgcccgccgagttgccggccgacctcgccaccttcgtcggccgcgagccccaggtggcccaactcgacgaggtgctcacggccgtcggccggccgtccgcgcccgcggtgatcgcgaccatcagcggcagcggcggagtgggcaagacgtcgctggccgtgcactgggcgcagcgggtgcgaccacatttccccgacgggcagctgttcgtcaacctccgcggcttcgacgcctccgcggcaccgatgagcgtggaggacgcgctgcgcgggctcctgcactccctcgggatgcgcccggaccggatcccgccggcgaccgaccggcaggcggcgctgtatcgcagcctgctcgccggcaagcggatgctggtcgtgttggacaatgcccgggacgccgaacaggtccggccgctgctgcccggcgcccccggctgcctggtgatcgtgaccagccgcaaccagctcccgggcctggtggccaccgacggcgcgacacccgttgcgctgggcctgctcgggcatgccgagggccgtcggctgctgcggcggcggctcggcggcgaccggatcgacgccgacaccggcgccctcgaccggatcgtcgaccggtgtgccgggctgcccctcgcgctggcggtcgtggccgcccggatgtcccagagccgccggctcaccctcggcgacctggccgcggagctggccgagtcacggaccgcgctggacaccctgggaaccggggaccgggcgagtgacctgcgctcggtgttcgcctggtcctaccaggcgctcagccggcccgcggcccgcctgttccgcctgctggggctgcaccccggcccggacgtctcggtgcacgccgccgccgccctcgccgacctcccgatcggccaggcccgccggatcctcgccgaactgacccgcgccaacctgctgtcggagcccacctacggccggttcgccgcgcacgaccttctctgggcgtacgcggtgggactcgccgaatccggcgaaccgccgcaggagcgccgagcagcccggctgcggctgctggagcactacgccgcgatgaccctgcacgcggccgagttgctcctgcccggccgggtcggatcgattccgctggtcgcgccgcagcgtaccgccgctgagcaggtcgacgacctgaaggacgcggtggcctggttcacggccgaaagcccggtgctgctgcggctggtgccggccgcgctgtcgaccggccaccaccggcaggcctggctgctggcctggggattgcgcgactacctcgaccaccggcggcagtgggacctccagatcaccgtgcagcaggccggcctggccgcggccgtgcacctcggcgactggaccgcgcaggcccacgcccaccgcaacctgggccgcgcgttcaccgagcagggccggatcgacgacgcgcggcacgcctaccggcaggcgttcaccgcattcgccgcagcgcgggaccaccacggtcaggccagcgtccacatgtccatggggctgctcgcccaacggcatcggcaaccccatcagtcgctgcaccactacctggcggccctgaaggccttcgagcagatcggcgacccgtcgggccaggcgaacgcgatgaacaacgtcgcctccggctacctcgaactcgaccagcacgaccaggcgttggagtacggtctgcgggcgctggacctcgcccacaccaccagcgcgtgggcccaggccgccatcctgaacacggtcggctccatctggcgccggcacggaaaacaccatcgggcggtcgagtgctacagccgctgcgtggcgctgatccgcagcgtcggcgaccgattccacgaggccgtggccctttgcgacctggccgacgcctgcgccgccgcgggcgacgagacgtcggcggcgcaggcccggacccaagctttggagatcgtcgggcacctcagcgaatcggacgccgcggtgatccgcacccggctgaatggcggctcgccttgacggttcgcggtatggtgcgtcgatatgggggcaatcaaaccgtggcacctgttcctgtgcctgatcgtggtactgctgatcgccggcgtggtggtggccgtggtcagtgcgggacggagaaagtagcaccccctcggctgtgctgacggcgggtgcgcagcaagcctgacctcttctgtcgcccgccgtggccgtcggctcggagtggctccgatcgcacagcggcttcctcgtcgcccgtcccgccgccggcatccggctcgtctcactgcgggtcgagcaacatgtgccatccgcgtcgaatccagggttcggcccctgccgcagggcatccgcacagcgttcagccgtggcccgggcaaggtccgcgtcgtcggcgctcatccagccgtggcgacgggcctgctcatactcgtcccagtcctcgatgtcgacacgcccgccaggccggtgcaggaccgggtccaactcgagatcgacatatcgccagcccgcatcggtcctctccggcggacggcagacgtcgatctccagccgctgatcggcaggatcgtcaatccaccaggccacccagggacggtccaccgtcagcaacaccaccaccggcacggacagggtgccgccgtcatgcggcgccccccacggcgaaccggccggccctcgcagccacgtaccgtcactgtcctgcccggccttctgaaggtcgtaccagaagacgccaccaggacgcttgatcttgttgagacggacgccgtcggtggccacctggatcttcacggacgcaccgtagaccgggtgcccagccaccatgggcgtggtcgagcggatccgagtctcaccgcgtcaatgcctccgtggtgggggtggtgtggagccaggtggcgagtctgtccacggtgtcgggccggagggccggcgcggcgtggtggagcagggcggtgagttcggtgcgctcgcgggtcgtgatgaccagctcgggtgttgcgccggcgcgccaggccgatgcggtggcgtcgcgggcgaggcgcgtgacgtcggctcgggcccgcgcggcaagcttcgggtccggatcagctgcggcgatgagtccggctcgcaggcatgttgcgacggtccctgcggtgagcaggcggtagccgccgcggcgctgggcggtcccggcgtcggtgagcagctgccagagaaggtccgcgtcgaccagcttcactatcggccgcaacgcgacgactgcttcgcggatcacctgcgcggacggatcgtgcagcagcggtatgacccgtgcggcctcggtcgcgtcgagctgacgcaaagcccgtaccgccgcggcgcggatcttcgcctccggatggttcaggagggggtggagcagcgccgattcccgcgccggggcggcctcggcgaaaccggcgatcgccggtggcgtcggtgcgtcgagcacggcggagcggtaccacgcgacggcgtcgacgccggcacggcgggccgcgtcgcgtgccaacgcccgtgccagcggtgccggatcggcgaggtgcgacgccacgtcggcgtcattgccggtgcggatcagtccggtcagcgccaaggaccgcacctctggccggcggcttcgggccagtcggtgcaatgcggtcaggcggcgccgccagacggcatcgcggcaggccgcctcggcagcgcgagcccgtaccggcgcgtccgggcccgactcggcaaggtctagcagttccggtggggagagcaagcccccgtcgagggcgaggtggcaggcgaagcgccgggaggcgaggggggatgacgccatcagaagccgccggtcggtgggcgatgcggccgagaaggcggccttcacctgggtcacgacgaacgcaccacggcagcgttggtcgatcgctgtcgtcaccggcagcacggcgcccagatacctggccggatcgtcggcgagcagcaatgccagaccggcacgggcccggtcacgcactgagcgaacccagtcaccggtccgcaacaccagcaacggcatcagttccaccgacggtgtggccagcatcgcggtaaccgcccgctcgcggacccgtccgtcaccatgagtgctggccagtgccaccgcgagcggagcctcgtacgcgccggctatcgcccgggtgaccacccgttcagccggcgatgccggaagcggctggcgccaccacgcgcgccgtgcgttctcatccagccgcaccacgacgcgcggccacccggcgaggaccgccagcgccgcgcagcccgactcccggtcaccggtggcggcaacctccgcgagcaacgtcgtgagatggccgaccggttcccacccgccacgagcggcttccgcaacggccgcccgcaccggatcggccgccggtggatccgccggcgcaggaacagacttccggtctcgccaccacgacttgatcaccgcgtcatcgtgccccagccgcgacgaacgcaccgcatgatttcacccgcactcgcagcctgcgccgtactcaccaggcggcagagacccgccggcatccgcttctgccgccgatggtgcccggcggtgaccctgcacgtacggcctcgaccgaagtgcgccgcttcagatcctggctctccccgtgggagcagggcattcaggtggcaggtgacgatcaggtgtcgccccacagggcttcgacggtgacgcccagcgcttgggcgatcttgatggccaggtagaccgacggggcgtagtcgccggtctccatcgcgatgatggtctgccggctcaccttcacctccgccgaaagtccctgctgggtgagtcctgcctcgcggcgcgccaggcggatgcgggcgccggccgcgccgtcggtcgccgcggcgcggaccgggccggacggtggtgccatcagtcctcgtcctcatcggcggcgagtgcctcggcggcggcgagtgcctgccgccgtcgcgccctgcccagcatcaggaggcatagcatggcgccgaacccgctgccgacgatcgcaccgatccaggcgtcacccgcgggatcgaaggcatacatcgcgccgacgacgaacacggcgtacggagtcacgctcagcgtcgcgatcagggtccgtttcgcactccagccgcgcggatcgacgcccgccttgcgccgagccacataggcggaacagagcaccatcggcgcccagagcaggaacaggacgaccgcgaggggcagcacggccggccggccgagcggccacaccatgatgccggccgcccaggggatgaggatcgagtgcagcgtggcggcggtgacgatcccctcgtaggagcggtagcgctcgcgttcgtcgccgtacagctggccgtcgatgtcgaggttccaccgcacgacgcggtcaaccagtgaagccgtcataccgccatcatcatgttaagtcctcttgacgtcaagaggacttaacatgggcccgcgggcgaggggcccggcatgacatcgtgtcgccatggtcgacaccgatgcgctgctggccgcctacgacgctcacatgcggtttccgaccggcgccgtcccggccgggatgagacacgagtacgacggggtgctcctgcggatcgtcggcgggcatgtcgggcgcatccgggcgccgcgcgacgtcggtgtcaccggcgccgggctcgaccgcctgatcgcccgtcaacgggactacttccgggcccgcggtgaaggcgtcgaatggaaggttcgctcccacgaccggcccgcagatcttccggaacgcctggtggcagccgggttcgtggcgggggagccggcatcggtgctgatcggctccgccgaggagatggccggcgatccggtcctgccggacggtgtcgtgctgcgccggatcagcgcggccggggacctgcgccggatggccgagctgcagagcgaggtgctgggcgaggactgctcctgggtggccgcccatctcgccgcccgggtgtcagccgatcccgatcagctcaccatcctggccgccgaagccggtggccggttcgtctgcaccgccctggtggagtactgcccgggcaccgacttcggggcactgctcggcggcgcgaccctgccggactggcaggggcgggggctgtaccgggccatgatcgccgctcgggcgcgggaggccgtcgcccgcggattccggctgctgcatgtcgacgcatccgcggccagcgcgcccatcctgcgtcggtgcggcttccacgagatcgccgtctcccggcactaccagtggacgccggaacacccggaagcatcgtaggatcgatgaatggacgaggcttcgtggtacggcccgccgcgggacgtcctgggccggacggtgccggtccagcaattcgtggtccggaccgggcacgtggtcgtcgcggtgccgcacctggtcgcgttccgcgagggctgcctcatcgtgctgctggtgaccgtgcgccgcggggggctcccgatggcggcctgggacaaccggctgggcggtcaccgcgccggaatgcccgacccggagggcctgacctgcgagattcaccttcgcggcggtacgtcggagccttcccggctcgtcgaagccggcgccgagtcgtccagcgacgaccgggagtaccgcggcgagctgagattctggctgcggccgctcccgcccccggcgccgttcgacctggtcgtcgccgggccgggcatgggtgtcgaccggagcgtcgtcacgctcgacggcggggcggtcgtccgggcggccgcccgcgccgcgccgttctggacctgaccggtcacgcctgcgcggcggcgcggagccgggccagggtctcggtcatggtgcggcggttgtgggcgtcgcggtcggtgatgcccagcgccgcgatgccgaacaatttgagggccgggccccggcggtcggtgtaggtctcggtcacctcgcagccgccgtcgaccgggcggaacgtgtacgtccaccgcgccacggcgaggaaaccggcgccgaccacgtcgaagctgaactcgcgaccgcggtcggccgccaccacggtgcacacggtgcgccaccggcggccgcggtgggcgttggcgccggtgaaccgggcccccacgcgcgggccgggcggttcggtgagccagcggcaccgggtcgtctccgggctccactggcccatccgggtgatgtcggcgacgagatcccagactgcctcgggggccgccgcgatgcgggtggtgacggtgacgggcatgccgccatcctgccctaccccggccggcccgcgggtgggcggaccggccgggagccgcggggtgttcagctgtgctcgacggcggcctgctgaatcgggagagccgccacgtaccgccgcaggaaagcgtcgaatccggcgacgtcggccggatcgggggtggcggtgtccaggcgggcgtcggcgaagaccgcggtggccagatagtcgtcgagggtctgtccgtcggcgcggccggtcaggaaggcggccaggatcgcgatgccccaggcgccgccctcgccggccaggtcaccgaccgagaccggggtgtcgatcgcggcggcgagcaggttctgcgcgacgccctcggtcttgaacagaccgccgtgcgcgaacatccggtcgagctggaccgcctccgccttctgcagcacgtccatgccgatgcgcagggtggcgagcgccgcgtacaactgggtccgcatgaaggtggcgagcgtcagcgagctgcccggctcgcgcaggaacagcgggcgcccctcgtgcagcctggtgatcggctcgccggagagattgttgaaggccatcaggccgccgccgtccggggcgcccttcagcgcggcgcggaacagggtctcgaacaccttgccgctgtccgccgggacgccgagggcggcggcgaactcggtgaacaggccggcccacgcgtcgagctcactggcgccgttgttgcagtggaccatggcgaccaggtcgccggccggggtggtgaccaggtcgatctcggggtgcacgcggctcagcgggctttccagcacgatcatggcgaagatgctggtaccggcgctgacgttgccggtgcggcgggcgaccgagttggtggcgaccatgccggtgccggcgtccccctcgggcgggcagagcgggatgccgggctgcagggcgccggtcgggtcgagcagccgggcgccggcctcggtcagcgtgccggcccgctcgccggcgggcagcacggcgggcagcaggtcgcgcaggggcagcggcaggccgcggccggcggccagggtgtcgaactgctccagcatccgggcgtcgtacccgccggtggtggtgtcgatcgggaacatgccgctggcgtcgccgacgccgagcaccttctccccggtgagcttccagtgcacgtatccggcgagggtggtgaaatgcgccagccggccgatgtgctccgcaccgttcaacaccgactggtacaggtgggcgatgctccagcggtgcgggatgttgtacgagaaaagctcgctgagtgcctcggcggcgtccccggtgtcggtgttgcgccaggtgcggaacggggtgagcagctccccgtcggcgtcgaaggcgaggtagccgtgcatcatcgcggacaccccgagcgcgccggtggtgcgcaactcgacgccgtggcgctcgcggacgtcgcgggccagcgccgcgaaacagtcctgcaggccggcccagacggcctccagcgagtacgtccacgtgcggtcgacgaactggttctcccagtcgtggctgccggtggcgatcgccgcatggccggggccggtcagcaccgccttgatccgggtcgaccccagctcgatgcccagggccgtgcggccctgctcgatcgcctcacgcacgccggccaggggccggtccaccgtctccgtcatggtgatgtttgtaccgcagtcggtgcggtctgcgaagaccggagtcggttaacgctaacttccagatggcgctgggtgctgaaccgatcagtttgttaacgctaacccggtcggcgacgcggctctccgaaccgggccgcggcgccgcgcgaagcgggcacgggcggtgccggccagcga
